United States Patent
Minomi et al.

(10) Patent No.: US 11,045,488 B2
(45) Date of Patent: *Jun. 29, 2021

(54) RNA INTERFERENCE AGENTS FOR GST-π GENE MODULATION

(71) Applicant: Nitto Denko Corporation, Osaka (JP)

(72) Inventors: Kenjirou Minomi, Osaka (JP); Hirokazu Takahashi, Osaka (JP); Erika Terada, Osaka (JP); Jens Harborth, Carlsbad, CA (US); Jun Zhang, San Diego, CA (US); Mohammad Ahmadian, Carlsbad, CA (US); Wenbin Ying, San Diego, CA (US)

(73) Assignee: Nitto Denko Corporation, Osaka (JP)

( * ) Notice: Subject to any disclaimer, the term of this patent is extended or adjusted under 35 U.S.C. 154(b) by 0 days.

This patent is subject to a terminal disclaimer.

(21) Appl. No.: 16/101,490

(22) Filed: Aug. 12, 2018

(65) Prior Publication Data

US 2018/0369274 A1    Dec. 27, 2018

Related U.S. Application Data

(63) Continuation-in-part of application No. 14/979,574, filed on Dec. 28, 2015, now Pat. No. 10,047,111, and a continuation-in-part of application No. 14/979,567, filed on Dec. 28, 2015, now Pat. No. 10,047,110.

(60) Provisional application No. 62/266,664, filed on Dec. 13, 2015, provisional application No. 62/184,239, filed on Jun. 24, 2015.

(30) Foreign Application Priority Data

Dec. 26, 2014 (JP) ................. 2014-266198

(51) Int. Cl.
*A61K 31/7105* (2006.01)
*C12N 15/113* (2010.01)
*A61P 35/00* (2006.01)

(52) U.S. Cl.
CPC .......... *A61K 31/7105* (2013.01); *A61P 35/00* (2018.01); *C12N 15/1135* (2013.01); *C12N 15/1137* (2013.01)

(58) Field of Classification Search
CPC .......... C12N 15/1135; C12N 15/1137
See application file for complete search history.

(56) References Cited

U.S. PATENT DOCUMENTS

| | | | |
|---|---|---|---|
| 5,968,737 A | 10/1999 | Ali-Osman | |
| 8,067,390 B2 | 11/2011 | Merritt | |
| 8,227,188 B2 | 7/2012 | de Fougerolles et al. | |
| 8,367,628 B2 | 2/2013 | Goodwin | |
| 8,603,995 B2 | 12/2013 | Labow et al. | |
| 8,664,376 B2 | 3/2014 | Niitsu | |
| 8,686,052 B2 | 4/2014 | Niitsu | |
| 8,710,209 B2 | 4/2014 | Jin | |
| 8,741,867 B2 | 6/2014 | Niitsu | |
| 8,895,717 B2 | 11/2014 | Sood | |
| 9,151,758 B2 | 10/2015 | Zetter | |
| 9,206,424 B2 | 12/2015 | Jin | |
| 9,771,582 B2 * | 9/2017 | Niitsu | C07D 311/30 |
| 9,914,983 B2 | 3/2018 | Niitsu et al. | |
| 10,047,110 B2 * | 8/2018 | Minomi | C12N 15/1137 |
| 10,047,111 B2 * | 8/2018 | Minomi | C12Q 1/02 |
| 2003/0099974 A1 | 5/2003 | Lillie et al. | |
| 2004/0029275 A1 | 2/2004 | Brown | |
| 2004/0219600 A1 | 11/2004 | Williams, III | |
| 2005/0142596 A1 | 6/2005 | Krolewski | |
| 2005/0233998 A1 | 10/2005 | Jadhav | |
| 2005/0245475 A1 | 11/2005 | Khvorova | |
| 2005/0255487 A1 | 11/2005 | Khvorova | |
| 2007/0083334 A1 | 4/2007 | Mintz | |
| 2007/0083945 A1 | 4/2007 | Byrum | |
| 2011/0269819 A1 | 11/2011 | Jones | |
| 2012/0276209 A1 | 11/2012 | Cullis | |
| 2013/0017249 A1 | 1/2013 | Niitsu | |
| 2013/0028885 A1 | 1/2013 | Zetter | |
| 2013/0052160 A1 | 2/2013 | Zitvogel | |
| 2013/0053270 A1 | 2/2013 | Gill | |
| 2013/0196434 A1 | 8/2013 | Maier | |
| 2013/0267581 A1 | 10/2013 | Niitsu | |

(Continued)

FOREIGN PATENT DOCUMENTS

CN    103619355 A    3/2014
CN    103695421 A    4/2014

(Continued)

OTHER PUBLICATIONS

Adler et.al, Regulation of JNK signaling by GSTp. EMBO J. 1999, 18, 1321-1334.
Ban et al., Transfection of Glutathione S-Transferase {GST)-π Antisense Complementary DNA Increases the Sensitivity of Colon Cancer Cell Line to Adriaimycin, Cisplatin, Melphalan, and Etoposide, Cancer Res., Aug. 1, 1996, vol. 56, 3577-3582

(Continued)

*Primary Examiner* — Richard A Schnizer
(74) *Attorney, Agent, or Firm* — Knobbe Martens Olson & Bear, LLP

(57) ABSTRACT

This invention provides compounds, compositions and methods for modulating the expression of human GST-π using RNA interference. The RNA interference molecules can be used in methods for preventing or treating diseases such as malignant tumor. Provided are a range of siRNA structures, having one or more of nucleotides being modified or chemically-modified. Advantageous structures include siRNAs with 2'-deoxy nucleotides located in the seed region, as well as other nucleotide modifications.

21 Claims, 17 Drawing Sheets

Specification includes a Sequence Listing.

(56) References Cited

U.S. PATENT DOCUMENTS

| | | |
|---|---|---|
| 2014/0005134 A1 | 1/2014 | Saus |
| 2014/0134158 A1 | 5/2014 | Bardelli |
| 2014/0294934 A1 | 10/2014 | Niitsu |
| 2014/0303237 A1 | 10/2014 | Shapiro et al. |
| 2014/0315975 A1 | 10/2014 | Niitsu et al. |
| 2014/0315976 A1 | 10/2014 | Brahmbhatt et al. |
| 2016/0187319 A1 | 6/2016 | Tanaka |

FOREIGN PATENT DOCUMENTS

| | | |
|---|---|---|
| EP | 2724729 | 4/2014 |
| JP | 2009-513151 A | 4/2009 |
| JP | 2009-536827 A | 10/2009 |
| JP | 2013-212113 A | 10/2013 |
| JP | 2018-512373 A | 5/2018 |
| JP | 2018-513669 A | 5/2018 |
| RU | 2448974 | 4/2012 |
| WO | WO 1998/021359 | 5/1998 |
| WO | WO 2004/094636 | 11/2004 |
| WO | WO 2007/051303 | 5/2007 |
| WO | WO 2007/061922 | 5/2007 |
| WO | WO 2007/072220 | 6/2007 |
| WO | WO 2007/134161 | 11/2007 |
| WO | WO 2009029688 A2 | 3/2009 |
| WO | WO 2009033284 A1 | 3/2009 |
| WO | WO 2012/176282 | 12/2012 |
| WO | WO 2012170952 A2 | 12/2012 |
| WO | WO 2013/075140 | 5/2013 |
| WO | WO 2013/192364 | 12/2013 |
| WO | WO 2014022739 A2 | 2/2014 |
| WO | WO 2014/098210 | 6/2014 |
| WO | WO 2016/106404 | 6/2016 |
| WO | WO 2016/106406 | 6/2016 |
| WO | WO 2017/106111 | 6/2017 |

OTHER PUBLICATIONS

Birkeland et al., KRAS gene amplification and overexpression but not mutation associates with aggressive and metastatic endometrial cancer, 2012, Br J Cancer, vol. 107, pp. 1997-2004.
Collins et al., KRAS as a key oncogene and therapeutic target in pancreatic cancer, Front Physiol. 2013, vol. 4, Article 107, pp. 1-8.
Futreal et al., A Census of Human Cancer Genes, Nature Reviews Cancer 2004, vol. 4, pp. 177-183.
GenBank Accession No. AC230665, Bos taurus clone CH240-502615, Jul. 10, 2008 [online]. [Retrieved on May 1, 2016]. Retrieved from the internet <URL:http://www.ncbi.nlm.nih.gov/nuccore/AC230665>.
GenBank Accession No. AC114115, Rattus norvegicus clone CH230-2808, Working Draft Sequence, 6 unordered pieces, May 13, 2003 [online]. [Retrieved on Apr. 30, 2016). Retrieved from the internet <URL:http://www.ncbi.nlm.nih.gov/nuccore/AC114115>.
GenBank Accession No. AC230574, Bos taurus clone CH240-504M17, Jul. 10, 2008 [online]. [Retrieved Jn May 1, 2016]. Retrieved from the internet <URL:http://www.ncbi.nlm.nih.gov/nuccore/AC230574>.
GenBank Accession No. AW374759, MR1-CT005B-291199-003-a05 CT0058 *Homo sapiens* cDNA. rnRNA sequence, Jan. 9, 2011 [online]. {Retrieved on May 1, 2016). Retrieved from the internet <URL: http://www.cbi.nlm.nih.gov/nucesl/6B79413/>.
GenBank Accession No. BV207757, sqnm2244B3 Human DNA {Sequenom) *Homo sapiens* STS genomic, Oct. 17, 2009 [online]. [Retrieved on May 1, 2016]. Retrieved from the internet <URL: http://www.ncbi.nlm.nih.gov/ uccore/BV207757>.
GenBank Accession No. G0761423, 0010260TNA004657HT OTNA Ovis aries cDNA 5-, mRNA sequence g May 2009 [online]. [Retrieved on Apr. 30, 2016]. Retrieved from the internet <URL: http://www.ncbi.nlm.nih.gov/ ucest/G0761423>.
GenBank Accession No. G0786145, 0009200TNA002813HT OTNA Ovis aries cDNA 5-,.mRNA sequence May 6, 2009 [online). [Retrieved on Apr. 30, 2016]. Retrieved from the internet <URL: http://www.ncbi.nlm.nih.gov/ ucest/G0786145>.
GenBank Accession No. JU528663, TSA: Ctenomys sociabilis 330326.Ctso mRNA sequence, Oct. 10, 2012 [online].[Retrieved on Apr. 30, 2016). Retrieved from the internet <URL: http://www.ncbi.nlm.nih.gov/nuccore/ JU528663>.
Hayashi et al., Suppressive effect of sulindac on branch duct-intraductal papillary mucinous neoplasms, J Gastroenterol., 2009, vol. 44, pp. 964-975.
Hida et al., Serum Glutathione S-Transferase-π Level as a Tumor Marker for Non-Small Cell Lung Cancer—Potential predictive value in chemotherapeutic resonse, Cancer, Mar. 1, 1994, vol. 73, No. 5, pp. 1377-1382.
Hirata et al., Significance of Glutathione S-Transferase-π as a Tumor Marker in Patients with Oral Cancer, Cancer, Nov. 15, 1992, vol. 70, No. 10, pp. 2381-2387.
Hokaiwado, Glutathione S-transferase Pi mediates proliferation of androgen-independent prostate cancer cells, Carcinogenesis, Apr. 15, 2008, vol. 29, pp. 1134-1138.
https://cansar.icr.ac.uk/cansar/cell-lines/A549/mutations/; retrieved online on Jun. 20, 2016.
Jackson et al., Expression profiling reveals off-target gene regulation by RNAi, 2003, Nature Biotechnology, vol. 21, pp. 535-637.
Love et al., Lipid-like materials for low-dose, in vivo gene silencing, Proc Natl Acad Sci U S A., 2010, vol. 107(5), pp. 1864-1869.
Matsunaga et al., C(H)OP refractory chronic lymphocytic leukemia patients in whom salvage chemotherapy chosen by evaluating multiple chemotherapeutic drug-resistant factors was remarkably effective, Int J Clin Oncol, 2003, vol. 8, pp. 326-331.
Miyanishi et al., Glutathione S-transferase-pi overexpression is closely associated with K-ras mutation during human colon carcinogenesis, Gastroenterology, 2001, vol. 121, pp. 865-874.
Morgan et al., Tumor Efficacy and Bone Marrow-sparing Properties of TER286, a Cytotoxin Activated by Glutathione S-Transferase, Cancer Res., Jun. 15, 1998, vol. 58, pp. 2568-2575.
Morse M.A., The role of glutathione S-transferase P1-1 in colorectal cancer: friend or foe?, Gastroenterology, 2001, vol. 121(4), pp. 1010-1013.
Müller et al., Thiazolides inhibit growth and induce glutathione-S-transferase Pi {GSTP1)-dependent cell death in human colon cancer cells, 2008, Int. J_ Cancer, vol. 123, pp. 1797-1806.
Nakajima et al., Reversal of multiple drug resistance in cholangiocarcinoma by the glutathione S-transferase-pi-specific inhibitor O1-hexadecyl-gamma-glutamyl-S-benzylcysteinyl-D-phenylglycine ethylester. J Pharmacol Exp Ther. 2003; 306 (3): 861-869.
Niitsu et al., A proof of glutathione S-transferase-pi-related multidrug resistance by transfer of antisense gene to cancer cells and sense gene to bone marrow stem cell, Chem Biol Interact., 1998, vol. 111-112, pp. 325-332.
Niitsu et al., Serum Glutathione-S-Transferase-π as a Tumor Marker for Gastrointestinal Malignancies, Cancer, Jan. 15, 1989, vol. 63, pp. 317-323.
Nishita et al., Regulation of autophagy and MAPK signaling b) Glutathione S-transferase Pi in KRAS mutated cancer cells, AACR 102nd Annual Meeting, 2011; Abstract No. 1065.
Ruan et al., Analysis of EGFR signaling pathway in nasopharyngeal carcinoma cells by quantitative phosphoproteomics, Proteome Sci., Jun. 28, 2011, vol. 9, 35, in 11 pages.
Sawers, Glutathione S-transferase Pi {GSTP1) directly influences platinum drug chemosensitivity in ovarian tumour cell lines, British Journal of Cancer, 2014, vol. 111, pp. 1150-1158.
Singhal et al., 1,3-bis(3,5-dichlorophenyl) Urea Compound 'COH-SR4' Inhibits Proliferation and Activates Apoptosis in Melanoma, Biochem Pharmacol., Dec. 1, 2012, vol. 84, Issue 11, pp. 1419-1427.
Steckel et al., Determination of synthetic lethal interactions in KRAS oncogene-dependent cancer cells reveals novel therapeutic targeting strategies, Cell Res. 2012, vol. 22(8), pp. 1227-1245.
Takahashi et al., [Glutathione S transferases-π], Article in Japanese; Gan To Kagaku Ryoho. 1994; 21 (7): 945-51, English summary p. 951.
Townsend et. al., Novel Role for Glutathione S-Transferase π—Regulator of Protein S-Glutathionylation Following Oxidative and Nitrosative Stress. J Biol Chem. 2009, vol. 284, 436-445.

(56) References Cited

OTHER PUBLICATIONS

Ui-Tei et al., Functional dissection of siRNA sequence by systematic DNA substitution: modified siRNA with a DNA seed arm is a powerful tool for mammalian gene silencing with significantly reduced off-target effect, Nucleic Acids Res., 2008, vol. 36(7), pp. 2136-2151.
Valtorta et al., KRAS gene amplification in colorectal cancer and impact on response to EGFR-targeted therapy, 2013, Int J Cancer, vol. 133, pp. 1259-1266.
Wagner et al., In Situ Evidence of KRAS Amplification and Association With Increased p21 Levels in Non-Small Cell Lung Carcinoma, 2009, Am J Clin Pathol, vol. 132, pp. 500-505.
Xu et al., Enhancing tumor cell response to chemotherapy through nanoparticle-mediated codelivery of siRNA and cisplatin prodrug, Proc Natl Acad Sci U S A, 2013, vol. 110, No. 46, pp. 18638-18643.
Xue et al., Small RNA combination therapy for lung cancer, Proc Natl Acad Sci USA, 2014, vol. 111(34), pp. E3553-E3561.
Yin et.al, Glutathione S-transferase p elicits protection against H2O2-induced cell death via coordinated regulation of stress kinases. Cancer Res. 2000, vol. 60, 4053-4057.
Chen et al., Sensitization of mesothelioma cells to platinum-based chemotherapy by GSTπ knockdown. Biochem Biophys Res Commun. 2014, 447(1):77-82.
Morrow et al., Structure of the human genomic glutathione S-transferase-pi gene. Gene, 1989, 75(1):3-11.
Patel et al., Rescue of paclitaxel sensitivity by repression of Prohibitin1 in drug-resistant cancer cells. PNAS U.S.A. Feb. 9, 2010; 107(6):2503-2508.
Nagaprashantha et al., "2'-Hydroxyflavanone inhibits proliferation, tumor vascularization and promotes normal differentiation in VHL-mutant renal cell carcinoma, 2011, Carcinogenesis", vol. 32, No. 4, pp. 568-575.
Noguchi et al.," PI3K-AKT Network Roles in Infectious Diseases, *Kansenshogaku zasshi*." The Journal of the Japanese Association for Infectious Diseases, 2008, vol. 82, No. 3, pp. 161-167.
Tripathi et al., "Reactive nitrogen species regulate autophagy through ATM-AMPK-TSC2-mediated suppression of mTORC1", Proceedings of the National Academy of Sciences, 2013, vol. 110, No. 32, pp. E2950-E2957.
Office Action issued in CN patent application No. 201580071191.3, dated May 24, 2019.

Office Action issued in JP patent application No. 2015-247725, dated Oct. 15, 2019.
Office Action issued in JP Patent Application No. 2018-134405, dated Apr. 2, 2019.
Japanese Office Action dated Oct. 23, 2018 for Application No. 2018-134405 in 7 pages.
Japanese Office Action dated Apr. 3, 2019 for Application No. 2018-134405 (w English Machine Translation) in 7 pages.
Russian Office Action dated Jun. 5, 2019 for Application No. 2017126613/10 (w English Translation) in 9 pages.
Chiu, Ya-Lin and Tariq M. Rana, "siRNA function in RNAi: A chemical modification analysis", RNA, Cold Spring Harbor Laboratory Press, vol. 9, Jan. 1, 2003 (Jan. 1, 2003), pp. 1034-1048.
Office Action issued in Taiwanese Application No. 105120007 dated May 6, 2020.
Search Report issued in European Patent Application No. 20156350.9 dated May 26, 2020.
Elbashir et al, "Functional anatomy of siRNAs for mediating efficient RNAi in Drosophila melanogaster embryo lysate", The EMBO Journal, (2001) 20:23, pp. 6877-6888.
Liu et al, "Biocompatible Flavone-Based Fluorogenic Probes for Quick Washfree Mitochondrial Imaging in living cells", ACS Appl Master.Interfaces (2014) 6, pp. 21638-21644.
Xia et al., "Cytoplasmic p21 is a potential predictor for cisplatin sensitivity in ovarian cancer" BMC Cancer (2011) 11:399, pp. 1-9.
Zhang, et al. "Reversal of multidrug resistance by small interfering double-stranded RNAs in ovarian cancer cells" Gynecologic Oncology (2005) 97, pp. 501-507.
Office Action received in Brazilian Application no. BR112017013597 dated Oct. 16, 2020 in 6 pages.
Examination Report received in Indian Application No. 201717026030, dated Apr. 8, 2021.
Fletcher et al., "Influence of glutathione-S-transferase (GST) inhibition on lung epithelial cell injury: role of oxidative stress and metabolism" Am. J. Physiol. Lung Cell Mol. Physiol., Apr. 2015, 308: L1274-L1285.
Schnekenburger et al., "Regulation of epigenetic traits of the glutathione S-transferase P1 gene: from detoxification toward cancer prevention and diagnosis" Frontiers in Pharmacology, Experimental Pharmacology and Drug Discovery, Jul. 2014, vol. 5, Article 170, pp. 1-7.

* cited by examiner

SEQ ID NO:1

```
TGGGAAAGAGGGAAAGGCTTCCCCGGCCAGCTGCGCGGCGACTCCGGGGACTCCAGGGCGCCCCTCTGCG
GCCGACGCCCGGGGTGCAGCGGCCGCCGGGGCTGGGGCCGGCGGGAGTCCGCGGGACCCTCCAGAAGAGC
GGCCGGCGCCGTGACTCAGCACTGGGGCGGAGCGGGGCGGGACCACCCTTATAAGGCTCGGAGGCCGCGA
GGCCTTCGCTGGAGTTTCGCCGCCGCAGTCTTCGCCACCATGCCGCCCTACACCGTGGTCTATTTCCCAG
TTCGAGGCCGCTGCGCGGCCCTGCGCATGCTGCTGGCAGATCAGGGCCAGAGCTGGAAGGAGGAGGTGGT
GACCGTGGAGACGTGGCAGGAGGGCTCACTCAAAGCCTCCTGCCTATACGGGCAGCTCCCCAAGTTCCAG
GACGGAGACCTCACCCTGTACCAGTCCAATACCATCCTGCGTCACCTGGGCCGCACCCTTGGGCTCTATG
GGAAGGACCAGCAGGAGGCAGCCCTGGTGGACATGGTGAATGACGGCGTGGAGGACCTCCGCTGCAAATA
CATCTCCCTCATCTACACCAACTATGAGGCGGGCAAGGATGACTATGTGAAGGCACTGCCCGGGCAACTG
AAGCCTTTTGAGACCCTGCTGTCCCAGAACCAGGGAGGCAAGACCTTCATTGTGGGAGACCAGATCTCCT
TCGCTGACTACAACCTGCTGGACTTGCTGCTGATCCATGAGGTCCTAGCCCCTGGCTGCCTGGATGCGTT
CCCCCTGCTCTCAGCATATGTGGGGCGCCTCAGTGCCCGGCCCAAGCTCAAGGCCTTCCTGGCCTCCCCT
GAGTACGTGAACCTCCCCATCAATGGCAACGGGAACAGTGAGGGTTGGGGGACTCTGAGCGGGAGGCA
GAGTTTGCCTTCCTTTCTCCAGGACCAATAAATTTCTAAGAGAGCTAAAAAAAAAAAAAAAAAAAAAA
AAAAAA
```

FIG. 1

FIG. 10
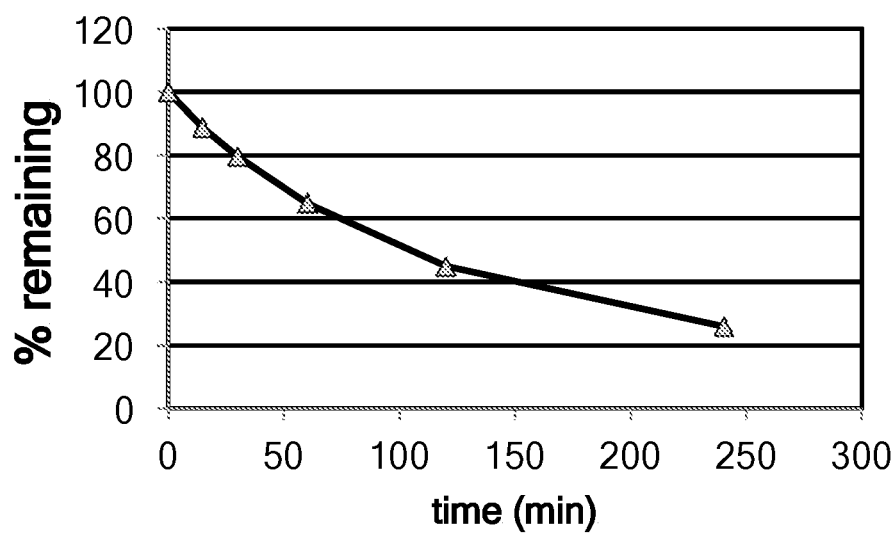
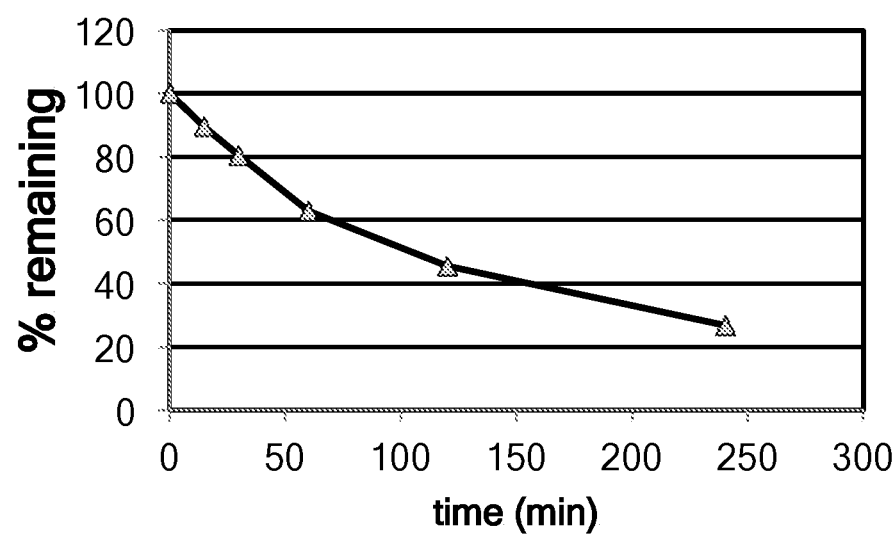

RNA INTERFERENCE AGENTS FOR GST-π GENE MODULATION

SEQUENCE LISTING

This application includes a Sequence Listing submitted electronically as an ASCII file created on Aug. 29, 2018, named ND8083385US_SL.txt, which is 520,556 bytes in size.

BACKGROUND OF THE INVENTION

Various human cancer tissues have been found to correlate with the appearance of mutated KRAS gene. In some cases, the tissues also present an elevated level of Glutathione S-Tranferase Pi (GST-π) expression. (Miyanishi et al., Gastroenterology, 2001, Vol. 121:865-874, Abstract) For example, elevated serum GST-π levels were observed in patients with various gastrointestinal malignancies. (Niitsu et al., Cancer, 1989, Vol. 63, No. 2, pp. 317-323, Abstract)

GST-π is a member of a GST family of enzymes that play a role in detoxification by catalyzing the conjugation of hydrophobic and electrophilic compounds with reduced glutathione. GST-π expression can be reduced in vitro with a siRNA. (Niitsu et al., US 2014/0315975 A1). However, there are many drawbacks of existing siRNA agents, such as insufficient activity, off target effects, lack of serum stability, and lack of in vivo potency or efficacy.

There is an urgent need for compositions and methods for modulating the expression of genes associated with cancer. In particular, therapeutics based on inhibition of GST-π expression will require highly potent and stable siRNA sequences and structures, which can reduce off target effects.

What is needed are siRNA sequences, compounds and structures for modulating GST-π expression, with uses for treating disease, such as malignant tumors.

BRIEF SUMMARY

This invention relates to the fields of biopharmaceuticals and therapeutics composed of nucleic acid based molecules. More particularly, this invention relates to compounds and compositions utilizing RNA interference (RNAi) for modulating the expression of human GST-π, and uses thereof.

This invention relates to compounds, compositions and methods for modulating the expression of human GST-π using RNA interference.

In some embodiments, this invention provides molecules for RNA interference gene silencing of GST-π.

In further embodiments, the structures, molecules and compositions of this invention can be used in methods for preventing or treating diseases, or ameliorating symptoms of conditions or disorders associated with GST-π, including malignant tumor.

Embodiments of this invention include the following:

A nucleic acid molecule for inhibiting expression of GST-π comprising a sense strand and an antisense strand, wherein the strands form a duplex region. The nucleic acid molecules can be siRNA molecules for inhibiting expression of GST-π, and may contain one or more nucleotides that are modified or chemically-modified.

In some embodiments, the nucleic acid siRNA molecules for inhibiting expression of GST-π may include 2'-deoxy nucleotides, 2'-O-alkyl substituted nucleotides, 2'-deoxy-2'-fluoro substituted nucleotides, or any combination thereof. In certain embodiments, the 2'-deoxy nucleotides may be in the seed region of the siRNA molecules. In certain aspects, the siRNA molecules for inhibiting expression of GST-π may have deoxynucleotides in a plurality of positions in the antisense strand.

The nucleic acid molecules of this invention may advantageously inhibit expression of GST-π mRNA with an IC50 of less than 300 pM. In certain embodiments, the nucleic acid molecules may inhibit expression of GST-π mRNA levels by at least 25% in vivo, upon a single administration of the molecules. In some embodiments, the nucleic acid molecules may have passenger strand off target activity reduced, or reduced by at least 50-fold, or at least 100-fold.

Embodiments of this invention further provide pharmaceutical compositions containing the siRNA molecules and a pharmaceutically acceptable carrier. In some embodiments, the carrier may be a lipid molecule, or liposome. This invention includes vectors or cells comprising the nucleic acid molecules.

Also contemplated in this invention are methods for treating a disease associated with GST-π expression, by administering to a subject in need a composition containing an siRNA, where the disease is malignant tumor, cancer, cancer caused by cells expressing mutated KRAS, sarcoma, or carcinoma.

BRIEF DESCRIPTION OF THE DRAWINGS

FIG. 1 shows SEQ ID NO: 1, which is the nucleic acid sequence of target human glutathione S-transferase pi (human GST-π) mRNA, disclosed in GenBank accession number NM_000852.3 (hGSTP1), which is 986 nucleotides in length.

As shown in FIG. 4, after 43 days, the GST-π siRNA showed markedly advantageous tumor inhibition, with final primary tumor average weights significantly reduced by 2.8-fold, as compared to control.

In FIG. 7, the expression of PUMA was greatly increased from 2-6 days after transfection of the GST-π siRNA.

As shown in FIG. 8, at a dose of 4 mg/kg, significant reduction of about 40% in GST-π mRNA was detected 24 hours after injection.

As shown in FIG. 9, a dose response was obtained with doses ranging from 0.375 mg/kg to 3 mg/kg of siRNA targeted to GST-π. The GST-π siRNA showed advantageous tumor inhibition within a few days after administration, the tumor volume being reduced by about 2-fold at the endpoint.

FIG. 10 shows that a GST-π siRNA of this invention exhibited increased serum stability. As shown in FIG. 10, the half-life ($t_{1/2}$) in serum for both the sense strand (FIG. 10, top) and antisense strand (FIG. 10, bottom) of a GST-π siRNA was about 100 minutes.

FIG. 11 shows incubation of a liposomal formulation of a GST-π siRNA in 50% human serum in PBS, and detection of remaining siRNA at various time points. As shown in FIG. 11, the half-life ($t_{1/2}$) in plasma of the formulation of the GST-π siRNA was significantly longer than 100 hours.

As shown in FIG. 12, the guide strand knockdown of the GST-π siRNA was approximately exponential, as compared to a control with scrambled sequence that exhibited no effect.

As shown in FIG. 13, the passenger strand off target knockdown for the GST-π siRNA was greatly reduced, with essentially no effect.

As shown in FIG. 14, the guide strand knockdown activities of the GST-π siRNAs were approximately exponential.

As shown in FIG. 15, the passenger strand off target knockdown activities for the GST-π siRNAs were significantly reduced below about 500 pM.

As shown in FIG. 16, the guide strand knockdown activity of the GST-π siRNA was approximately exponential.

As shown in FIG. 17, the passenger strand off target knockdown activity for the GST-π siRNA was significantly reduced.

DETAILED DESCRIPTION OF THE INVENTION

Figure 2:
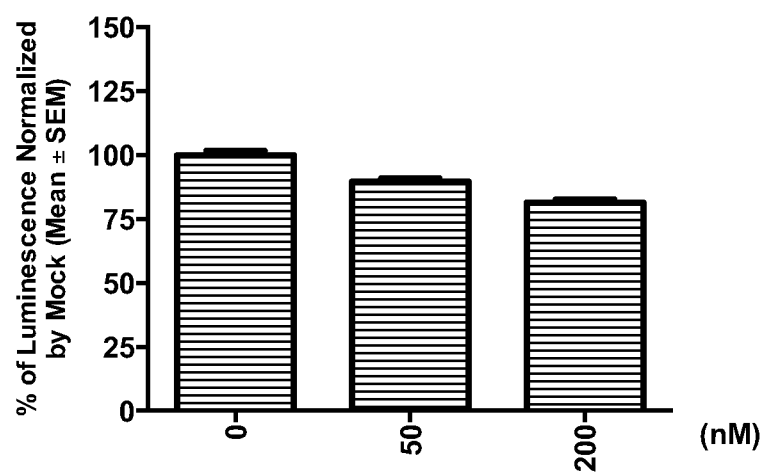
FIG. 2 shows inhibition of proliferation by GST-π siRNA. Dose-dependent inhibition of proliferation was observed in an A549 cell line in vitro with siRNA targeted to GST-π, as shown in FIG. 2.

This invention relates to compounds, compositions and methods for nucleic acid based therapeutics for modulating expression of GST-π.

In some embodiments, this invention provides molecules active in RNA interference, as well as structures and compositions that can silence expression of GST-π.

The structures and compositions of this disclosure can be used in preventing or treating various diseases such as malignant tumor.

In further embodiments, this invention provides compositions for delivery and uptake of one or more therapeutic RNAi molecules of this invention, as well as methods of use thereof. The RNA-based compositions of this invention can be used in methods for preventing or treating malignant tumors, such as cancers.

Therapeutic compositions of this invention include nucleic acid molecules that are active in RNA interference. The therapeutic nucleic acid molecules can be targeted to GSTP1 (GST-π) for gene silencing.

In various embodiments, this invention provides a range of molecules that can be active as a small interfering RNA (siRNA), and can regulate or silence GST-π gene expression.

The siRNAs of this invention can be used for preventing or treating malignant tumors.

Embodiments of this invention further provide a vehicle, formulation, or lipid nanoparticle formulation for delivery of the inventive siRNAs to subjects in need of preventing or treating a malignant tumor. This invention further contemplates methods for administering siRNAs as therapeutics to mammals.

The therapeutic molecules and compositions of this invention can be used for RNA interference directed to preventing or treating a GST-π associated disease, by administering a compound or composition to a subject in need.

The methods of this invention can utilize the inventive compounds for preventing or treating malignant tumor.

In some aspects, the malignant tumor can be presented in various diseases, for example, cancers that highly expressing GST-π, cancers caused by cells expressing mutated KRAS, sarcomas, fibrosarcoma, malignant fibrous histiocytoma, liposarcoma, rhabdomyosarcoma, leiomyosarcoma, angiosarcoma, Kaposi's sarcoma, lymphangiosarcoma, synovial sarcoma, chondrosarcoma, osteosarcoma, and carcinomas.

In certain aspects, methods of this invention can utilize the inventive compounds for preventing or treating malignant tumors and cancers in any organ or tissue, including, for example, brain tumor, head and neck cancer, breast cancer, lung cancer, esophageal cancer, stomach cancer, duodenal cancer, colorectal cancer, liver cancer, pancreatic cancer, gallbladder cancer, bile duct cancer, kidney cancer, urethral cancer, bladder cancer, prostate cancer, testicular cancer, uterine cancer, ovary cancer, skin cancer, leukemia, malignant lymphoma, epithelial malignant tumors, and non-epithelial malignant tumors.

In certain embodiments, a combination of therapeutic molecules of this invention can be used for silencing or inhibiting GST-π gene expression.

This invention provides a range of RNAi molecules, where each molecule has a polynucleotide sense strand and a polynucleotide antisense strand; each strand of the molecule is from 15 to 30 nucleotides in length; a contiguous region of from 15 to 30 nucleotides of the antisense strand is complementary to a sequence of an mRNA encoding GST-π; and at least a portion of the sense strand is complementary to at least a portion of the antisense strand, and the molecule has a duplex region of from 15 to 30 nucleotides in length.

A RNAi molecule of this invention can have a contiguous region of from 15 to 30 nucleotides of the antisense strand that is complementary to a sequence of an mRNA encoding GST-π, which is located in the duplex region of the molecule.

In some embodiments, a RNAi molecule can have a contiguous region of from 15 to 30 nucleotides of the antisense strand that is complementary to a sequence of an mRNA encoding GST-π.

Embodiments of this invention may further provide methods for preventing, treating or ameliorating one or more symptoms of malignant tumor, or reducing the risk of developing malignant tumor, or delaying the onset of malignant tumor in a mammal in need thereof.

GST-π and RNAi Molecules

FIG. 1 shows the nucleic acid sequence of an example target human glutathione S-transferase pi (human GST-π) mRNA, which is disclosed in GenBank accession number NM_000852.3 (hGSTP1), and is 986 nucleotides in length (SEQ ID NO: 1).

One of ordinary skill in the art would understand that a reported sequence may change over time and to incorporate any changes needed in the nucleic acid molecules herein accordingly.

Embodiments of this invention can provide compositions and methods for gene silencing of GST-π expression using small nucleic acid molecules. Examples of nucleic acid molecules include molecules active in RNA interference (RNAi molecules), short interfering RNA (siRNA), double-stranded RNA (dsRNA), micro-RNA (miRNA), and short hairpin RNA (shRNA) molecules, as well as DNA-directed RNAs (ddRNA), Piwi-interacting RNAs (piRNA), and repeat associated siRNAs (rasiRNA). Such molecules are capable of mediating RNA interference against GST-π gene expression.

The composition and methods disclosed herein can also be used in treating various kinds of malignant tumors in a subject.

The nucleic acid molecules and methods of this invention may be used to down regulate the expression of genes that encode GST-π.

The compositions and methods of this invention can include one or more nucleic acid molecules, which, independently or in combination, can modulate or regulate the expression of GST-π protein and/or genes encoding GST-π proteins, proteins and/or genes encoding GST-π associated with the maintenance and/or development of diseases, conditions or disorders associated with GST-π, such as malignant tumor.

The compositions and methods of this invention are described with reference to exemplary sequences of GST-π. A person of ordinary skill in the art would understand that various aspects and embodiments of the invention are directed to any related GST-π genes, sequences, or variants, such as homolog genes and transcript variants, and polymorphisms, including single nucleotide polymorphism (SNP) associated with any GST-π genes.

In some embodiments, the compositions and methods of this invention can provide a double-stranded short interfering nucleic acid (siRNA) molecule that downregulates the expression of a GST-π gene, for example human GST-π.

A RNAi molecule of this invention can be targeted to GST-π and any homologous sequences, for example, using complementary sequences or by incorporating non-canonical base pairs, for example, mismatches and/or wobble base pairs, that can provide additional target sequences.

In instances where mismatches are identified, non-canonical base pairs, for example, mismatches and/or wobble bases can be used to generate nucleic acid molecules that target more than one gene sequence.

For example, non-canonical base pairs such as UU and CC base pairs can be used to generate nucleic acid molecules that are capable of targeting sequences for differing GST-π targets that share sequence homology. Thus, a RNAi molecule can be targeted to a nucleotide sequence that is conserved between homologous genes, and a single RNAi molecule can be used to inhibit expression of more than one gene.

In some aspects, the compositions and methods of this invention include RNAi molecules that are active against GST-π mRNA, where the RNAi molecule includes a sequence complementary to any mRNA encoding a GST-π sequence.

In some embodiments, a RNAi molecule of this disclosure can have activity against GST-π RNA, where the RNAi molecule includes a sequence complementary to an RNA having a variant GST-π encoding sequence, for example, a mutant GST-π gene known in the art to be associated with malignant tumor.

In further embodiments, a RNAi molecule of this invention can include a nucleotide sequence that can interact with a nucleotide sequence of a GST-π gene and mediate silencing of GST-π gene expression.

The nucleic acid molecules for inhibiting expression of GST-π may have a sense strand and an antisense strand, wherein the strands form a duplex region. The nucleic acid molecules may have one or more of the nucleotides in the duplex region being modified or chemically-modified, including such modifications as are known in the art. Any nucleotide in an overhang of the siRNA may also be modified or chemically-modified.

In some embodiments, the preferred modified or chemically-modified nucleotides are 2'-deoxy nucleotides. In additional embodiments, the modified or chemically-modified nucleotides can include 2'-O-alkyl substituted nucleotides, 2'-deoxy-2'-fluoro substituted nucleotides, phosphorothioate nucleotides, locked nucleotides, or any combination thereof.

In certain embodiments, a preferred structure can have an antisense strand containing deoxynucleotides in a plurality of positions, the plurality of positions being one of the following: each of positions 4, 6 and 8, from the 5' end of the antisense strand; each of positions 3, 5 and 7, from the 5' end of the antisense strand; each of positions 1, 3, 5 and 7, from the 5' end of the antisense strand; each of positions 3-8, from the 5' end of the antisense strand; and each of positions 5-8, from the 5' end of the antisense strand. Any of these structures can be combined with one or more 2'-deoxy-2'-fluoro substituted nucleotides in the duplex region.

The nucleic acid molecules of this invention can inhibit expression of GST-π mRNA with an advantageous IC50 of less than about 300 pM, or less than about 200 pM, or less than about 100 pM, or less than about 50 pM.

Further, the nucleic acid molecules can inhibit expression of GST-π mRNA levels by at least 25% in vivo, upon a single administration.

Pharmaceutical compositions are contemplated in this invention, which can contain one or more siRNAs as described herein, in combination with a pharmaceutically acceptable carrier. Any suitable carrier may be used, including those known in the art, as well as lipid molecules, nanoparticles, or liposomes, any of which may encapsulate the siRNA molecules.

This invention discloses methods for treating a disease associated with GST-π expression, which methods include administering to a subject in need a composition containing one or more of the siRNAs. Diseases to be treated may include malignant tumor, cancer, cancer caused by cells expressing mutated KRAS, sarcoma, and carcinoma, among others.

Examples of RNAi molecules of this invention targeted to GST-π mRNA are shown in Table 1.

TABLE 1

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 232 | 2 | GCCGCAGUCUUCGCCACCAtt | 609 | UGGUGGCGAAGACUGCGGCgg |
| 233 | 3 | CCGCAGUCUUCGCCACCAUtt | 610 | AUGGUGGCGAAGACUGCGGcg |
| 234 | 4 | CGCAGUCUUCGCCACCAUGtt | 611 | CAUGGUGGCGAAGACUGCGgc |
| 235 | 5 | GCAGUCUUCGCCACCAUGCtt | 612 | GCAUGGUGGCGAAGACUGCgg |
| 236 | 6 | CAGUCUUCGCCACCAUGCCtt | 613 | GGCAUGGUGGCGAAGACUGcg |
| 237 | 7 | AGUCUUCGCCACCAUGCCGtt | 614 | CGGCAUGGUGGCGAAGACUgc |
| 238 | 8 | GUCUUCGCCACCAUGCCGCtt | 615 | GCGGCAUGGUGGCGAAGACtg |
| 239 | 9 | UCUUCGCCACCAUGCCGCCtt | 616 | GGCGGCAUGGUGGCGAAGAct |
| 240 | 10 | CUUCGCCACCAUGCCGCCCtt | 617 | GGGCGGCAUGGUGGCGAAGac |
| 241 | 11 | UUCGCCACCAUGCCGCCCUtt | 618 | AGGGCGGCAUGGUGGCGAAga |
| 242 | 12 | UCGCCACCAUGCCGCCCUAtt | 619 | UAGGGCGGCAUGGUGGCGAag |
| 243 | 13 | CGCCACCAUGCCGCCCUACtt | 620 | GUAGGGCGGCAUGGUGGCGaa |
| 244 | 14 | GCCACCAUGCCGCCCUACAtt | 621 | UGUAGGGCGGCAUGGUGGCga |
| 245 | 15 | CCACCAUGCCGCCCUACACtt | 622 | GUGUAGGGCGGCAUGGUGGcg |
| 246 | 16 | CACCAUGCCGCCCUACACCtt | 623 | GGUGUAGGGCGGCAUGGUGgc |
| 247 | 17 | ACCAUGCCGCCCUACACCGtt | 624 | CGGUGUAGGGCGGCAUGGUgg |
| 248 | 18 | CCAUGCCGCCCUACACCGUtt | 625 | ACGGUGUAGGGCGGCAUGGtg |
| 249 | 19 | CAUGCCGCCCUACACCGUGtt | 626 | CACGGUGUAGGGCGGCAUGgt |
| 250 | 20 | AUGCCGCCCUACACCGUGGtt | 627 | CCACGGUGUAGGGCGGCAUgg |
| 251 | 21 | UGCCGCCCUACACCGUGGUtt | 628 | ACCACGGUGUAGGGCGGCAtg |
| 252 | 22 | GCCGCCCUACACCGUGGUCtt | 629 | GACCACGGUGUAGGGCGGcat |
| 253 | 23 | CCGCCCUACACCGUGGUCUtt | 630 | AGACCACGGUGUAGGGCGGca |
| 254 | 24 | CGCCCUACACCGUGGUCUAtt | 631 | UAGACCACGGUGUAGGGCGgc |
| 255 | 25 | GCCCUACACCGUGGUCUAUtt | 632 | AUAGACCACGGUGUAGGGCgg |
| 256 | 26 | CCCUACACCGUGGUCUAUUtt | 633 | AAUAGACCACGGUGUAGGGcg |
| 257 | 27 | CCUACACCGUGGUCUAUUUtt | 634 | AAAUAGACCACGGUGUAGGgc |
| 258 | 28 | CUACACCGUGGUCUAUUUCtt | 635 | GAAAUAGACCACGGUGUAGgg |
| 259 | 29 | UACACCGUGGUCUAUUUCCtt | 636 | GGAAAUAGACCACGGUGUAgg |
| 260 | 30 | ACACCGUGGUCUAUUUCCCtt | 637 | GGGAAAUAGACCACGGUGUag |
| 261 | 31 | CACCGUGGUCUAUUUCCCAtt | 638 | UGGGAAAUAGACCACGGUGta |
| 262 | 32 | ACCGUGGUCUAUUUCCCAGtt | 639 | CUGGGAAAUAGACCACGGUgt |
| 263 | 33 | CCGUGGUCUAUUUCCCAGUtt | 640 | ACUGGGAAAUAGACCACGGtg |
| 264 | 34 | CGUGGUCUAUUUCCCAGUUtt | 641 | AACUGGGAAAUAGACCACGgt |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 265 | 35 | GUGGUCUAUUUCCCAGUUCtt | 642 | GAACUGGGAAAUAGACCACgg |
| 266 | 36 | UGGUCUAUUUCCCAGUUCGtt | 643 | CGAACUGGGAAAUAGACCAcg |
| 267 | 37 | GGUCUAUUUCCCAGUUCGAtt | 644 | UCGAACUGGGAAAUAGACCac |
| 268 | 38 | GUCUAUUUCCCAGUUCGAGtt | 645 | CUCGAACUGGGAAAUAGACca |
| 269 | 39 | UCUAUUUCCCAGUUCGAGGtt | 646 | CCUCGAACUGGGAAAUAGAcc |
| 270 | 40 | CUAUUUCCCAGUUCGAGGCtt | 647 | GCCUCGAACUGGGAAAUAGac |
| 271 | 41 | UAUUUCCCAGUUCGAGGCCtt | 648 | GGCCUCGAACUGGGAAAUAga |
| 272 | 42 | AUUUCCCAGUUCGAGGCCGtt | 649 | CGGCCUCGAACUGGGAAAUag |
| 273 | 43 | UUUCCCAGUUCGAGGCCGCtt | 650 | GCGGCCUCGAACUGGGAAAta |
| 274 | 44 | UUCCCAGUUCGAGGCCGCUtt | 651 | AGCGGCCUCGAACUGGGAAat |
| 275 | 45 | UCCCAGUUCGAGGCCGCUGtt | 652 | CAGCGGCCUCGAACUGGGAaa |
| 276 | 46 | CCCAGUUCGAGGCCGCUGCtt | 653 | GCAGCGGCCUCGAACUGGGaa |
| 277 | 47 | CCAGUUCGAGGCCGCUGCGtt | 654 | CGCAGCGGCCUCGAACUGGga |
| 278 | 48 | CAGUUCGAGGCCGCUGCGCtt | 655 | GCGCAGCGGCCUCGAACUGgg |
| 279 | 49 | AGUUCGAGGCCGCUGCGCGtt | 656 | CGCGCAGCGGCCUCGAACUgg |
| 280 | 50 | GUUCGAGGCCGCUGCGCGGtt | 657 | CCGCGCAGCGGCCUCGAACtg |
| 281 | 51 | UUCGAGGCCGCUGCGCGGCtt | 658 | GCCGCGCAGCGGCCUCGAAct |
| 282 | 52 | UCGAGGCCGCUGCGCGGCCtt | 659 | GGCCGCGCAGCGGCCUCGAac |
| 283 | 53 | CGAGGCCGCUGCGCGGCCCtt | 660 | GGGCCGCGCAGCGGCCUCGaa |
| 284 | 54 | GAGGCCGCUGCGCGGCCCUtt | 661 | AGGGCCGCGCAGCGGCCUCga |
| 285 | 55 | AGGCCGCUGCGCGGCCCUGtt | 662 | CAGGGCCGCGCAGCGGCCUcg |
| 286 | 56 | GGCCGCUGCGCGGCCCUGCtt | 663 | GCAGGGCCGCGCAGCGGCCtc |
| 287 | 57 | GCCGCUGCGCGGCCCUGCGtt | 664 | CGCAGGGCCGCGCAGCGGCct |
| 288 | 58 | CCGCUGCGCGGCCCUGCGCtt | 665 | GCGCAGGGCCGCGCAGCGGcc |
| 289 | 59 | CGCUGCGCGGCCCUGCGCAtt | 666 | UGCGCAGGGCCGCGCAGCGgc |
| 290 | 60 | GCUGCGCGGCCCUGCGCAUtt | 667 | AUGCGCAGGGCCGCGCAGCgg |
| 291 | 61 | CUGCGCGGCCCUGCGCAUGtt | 668 | CAUGCGCAGGGCCGCGCAGcg |
| 292 | 62 | UGCGCGGCCCUGCGCAUGCtt | 669 | GCAUGCGCAGGGCCGCGCAgc |
| 293 | 63 | GCGCGGCCCUGCGCAUGCUtt | 670 | AGCAUGCGCAGGGCCGCGCag |
| 294 | 64 | CGCGGCCCUGCGCAUGCUGtt | 671 | CAGCAUGCGCAGGGCCGCGca |
| 295 | 65 | GCGGCCCUGCGCAUGCUGCtt | 672 | GCAGCAUGCGCAGGGCCGCgc |
| 296 | 66 | CGGCCCUGCGCAUGCUGCUtt | 673 | AGCAGCAUGCGCAGGGCCGcg |
| 297 | 67 | GGCCCUGCGCAUGCUGCUGtt | 674 | CAGCAGCAUGCGCAGGGCCgc |
| 298 | 68 | GCCCUGCGCAUGCUGCUGGtt | 675 | CCAGCAGCAUGCGCAGGGCcg |
| 299 | 69 | CCCUGCGCAUGCUGCUGGCtt | 676 | GCCAGCAGCAUGCGCAGGGcc |
| 300 | 70 | CCUGCGCAUGCUGCUGGCAtt | 677 | UGCCAGCAGCAUGCGCAGGgc |
| 301 | 71 | CUGCGCAUGCUGCUGGCAGtt | 678 | CUGCCAGCAGCAUGCGCAGgg |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 302 | 72 | UGCGCAUGCUGCUGGCAGAtt | 679 | UCUGCCAGCAGCAUGCGCAgg |
| 303 | 73 | GCGCAUGCUGCUGGCAGAUtt | 680 | AUCUGCCAGCAGCAUGCGCag |
| 304 | 74 | CGCAUGCUGCUGGCAGAUCtt | 681 | GAUCUGCCAGCAGCAUGCGca |
| 305 | 75 | GCAUGCUGCUGGCAGAUCAtt | 682 | UGAUCUGCCAGCAGCAUGCgc |
| 306 | 76 | CAUGCUGCUGGCAGAUCAGtt | 683 | CUGAUCUGCCAGCAGCAUGcg |
| 307 | 77 | AUGCUGCUGGCAGAUCAGGtt | 684 | CCUGAUCUGCCAGCAGCAUgc |
| 308 | 78 | UGCUGCUGGCAGAUCAGGGtt | 685 | CCCUGAUCUGCCAGCAGCAtg |
| 309 | 79 | GCUGCUGGCAGAUCAGGGCtt | 686 | GCCCUGAUCUGCCAGCAGCat |
| 310 | 80 | CUGCUGGCAGAUCAGGGCCtt | 687 | GGCCCUGAUCUGCCAGCAGca |
| 311 | 81 | UGCUGGCAGAUCAGGGCCAtt | 688 | UGGCCCUGAUCUGCCAGCAgc |
| 312 | 82 | GCUGGCAGAUCAGGGCCAGtt | 689 | CUGGCCCUGAUCUGCCAGCag |
| 313 | 83 | CUGGCAGAUCAGGGCCAGAtt | 690 | UCUGGCCCUGAUCUGCCAGca |
| 314 | 84 | UGGCAGAUCAGGGCCAGAGtt | 691 | CUCUGGCCCUGAUCUGCCAgc |
| 315 | 85 | GGCAGAUCAGGGCCAGAGCtt | 692 | GCUCUGGCCCUGAUCUGCCag |
| 316 | 86 | GCAGAUCAGGGCCAGAGCUtt | 693 | AGCUCUGGCCCUGAUCUGCca |
| 317 | 87 | CAGAUCAGGGCCAGAGCUGtt | 694 | CAGCUCUGGCCCUGAUCUGcc |
| 318 | 88 | AGAUCAGGGCCAGAGCUGGtt | 695 | CCAGCUCUGGCCCUGAUCUgc |
| 319 | 89 | GAUCAGGGCCAGAGCUGGAtt | 696 | UCCAGCUCUGGCCCUGAUCtg |
| 320 | 90 | AUCAGGGCCAGAGCUGGAAtt | 697 | UUCCAGCUCUGGCCCUGAUct |
| 321 | 91 | UCAGGGCCAGAGCUGGAAGtt | 698 | CUUCCAGCUCUGGCCCUGAtc |
| 322 | 92 | CAGGGCCAGAGCUGGAAGGtt | 699 | CCUUCCAGCUCUGGCCCUGat |
| 323 | 93 | AGGGCCAGAGCUGGAAGGAtt | 700 | UCCUUCCAGCUCUGGCCCUga |
| 324 | 94 | GGGCCAGAGCUGGAAGGAGtt | 701 | CUCCUUCCAGCUCUGGCCCtg |
| 325 | 95 | GGCCAGAGCUGGAAGGAGGtt | 702 | CCUCCUUCCAGCUCUGGCCct |
| 326 | 96 | GCCAGAGCUGGAAGGAGGAtt | 703 | UCCUCCUUCCAGCUCUGGCcc |
| 327 | 97 | CCAGAGCUGGAAGGAGGAGtt | 704 | CUCCUCCUUCCAGCUCUGGcc |
| 328 | 98 | CAGAGCUGGAAGGAGGAGGtt | 705 | CCUCCUCCUUCCAGCUCUGgc |
| 329 | 99 | AGAGCUGGAAGGAGGAGGUtt | 706 | ACCUCCUCCUUCCAGCUCUgg |
| 330 | 100 | GAGCUGGAAGGAGGAGGUGtt | 707 | CACCUCCUCCUUCCAGCUCtg |
| 330 | 101 | GAGCUGGAAGGAGGAGGUAtt | 708 | UACCUCCUCCUUCCAGCUCtg |
| 331 | 102 | AGCUGGAAGGAGGAGGUGGtt | 709 | CCACCUCCUCCUUCCAGCUct |
| 332 | 103 | GCUGGAAGGAGGAGGUGGUtt | 710 | ACCACCUCCUCCUUCCAGCtc |
| 333 | 104 | CUGGAAGGAGGAGGUGGUGtt | 711 | CACCACCUCCUCCUUCCAGct |
| 334 | 105 | UGGAAGGAGGAGGUGGUGAtt | 712 | UCACCACCUCCUCCUUCCAgc |
| 335 | 106 | GGAAGGAGGAGGUGGUGACtt | 713 | GUCACCACCUCCUCCUUCCag |
| 336 | 107 | GAAGGAGGAGGUGGUGACCtt | 714 | GGUCACCACCUCCUCCUUCca |
| 337 | 108 | AAGGAGGAGGUGGUGACCGtt | 715 | CGGUCACCACCUCCUCCUUcc |
| 338 | 109 | AGGAGGAGGUGGUGACCGUtt | 716 | ACGGUCACCACCUCCUCCUtc |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---------|-----------|------------------------------------------------|-----------|-------------------------------------------------------|
| 339 | 110 | GGAGGAGGUGGUGACCGUGtt | 717 | CACGGUCACCACCUCCUCCtt |
| 340 | 111 | GAGGAGGUGGUGACCGUGGtt | 718 | CCACGGUCACCACCUCCUCct |
| 341 | 112 | AGGAGGUGGUGACCGUGGAtt | 719 | UCCACGGUCACCACCUCCUcc |
| 342 | 113 | GGAGGUGGUGACCGUGGAGtt | 720 | CUCCACGGUCACCACCUCCtc |
| 343 | 114 | GAGGUGGUGACCGUGGAGAtt | 721 | UCUCCACGGUCACCACCUCct |
| 344 | 115 | AGGUGGUGACCGUGGAGACtt | 722 | GUCUCCACGGUCACCACCUcc |
| 345 | 116 | GGUGGUGACCGUGGAGACGtt | 723 | CGUCUCCACGGUCACCACCtc |
| 346 | 117 | GUGGUGACCGUGGAGACGUtt | 724 | ACGUCUCCACGGUCACCACct |
| 347 | 118 | UGGUGACCGUGGAGACGUGtt | 725 | CACGUCUCCACGGUCACCAcc |
| 348 | 119 | GGUGACCGUGGAGACGUGGtt | 726 | CCACGUCUCCACGGUCACCac |
| 349 | 120 | GUGACCGUGGAGACGUGGCtt | 727 | GCCACGUCUCCACGGUCACca |
| 350 | 121 | UGACCGUGGAGACGUGGCAtt | 728 | UGCCACGUCUCCACGGUCAcc |
| 351 | 122 | GACCGUGGAGACGUGGCAGtt | 729 | CUGCCACGUCUCCACGGUCac |
| 352 | 123 | ACCGUGGAGACGUGGCAGGtt | 730 | CCUGCCACGUCUCCACGGUca |
| 353 | 124 | CCGUGGAGACGUGGCAGGAtt | 731 | UCCUGCCACGUCUCCACGGtc |
| 354 | 125 | CGUGGAGACGUGGCAGGAGtt | 732 | CUCCUGCCACGUCUCCACGgt |
| 355 | 126 | GUGGAGACGUGGCAGGAGGtt | 733 | CCUCCUGCCACGUCUCCACgg |
| 356 | 127 | UGGAGACGUGGCAGGAGGGtt | 734 | CCCUCCUGCCACGUCUCCAcg |
| 357 | 128 | GGAGACGUGGCAGGAGGGCtt | 735 | GCCCUCCUGCCACGUCUCCac |
| 358 | 129 | GAGACGUGGCAGGAGGGCUtt | 736 | AGCCCUCCUGCCACGUCUCca |
| 359 | 130 | AGACGUGGCAGGAGGGCUCtt | 737 | GAGCCCUCCUGCCACGUCUcc |
| 360 | 131 | GACGUGGCAGGAGGGCUCAtt | 738 | UGAGCCCUCCUGCCACGUCtc |
| 361 | 132 | ACGUGGCAGGAGGGCUCACtt | 739 | GUGAGCCCUCCUGCCACGUct |
| 362 | 133 | CGUGGCAGGAGGGCUCACUtt | 740 | AGUGAGCCCUCCUGCCACGtc |
| 363 | 134 | GUGGCAGGAGGGCUCACUCtt | 741 | GAGUGAGCCCUCCUGCCACgt |
| 364 | 135 | UGGCAGGAGGGCUCACUCAtt | 742 | UGAGUGAGCCCUCCUGCCAcg |
| 365 | 136 | GGCAGGAGGGCUCACUCAAtt | 743 | UUGAGUGAGCCCUCCUGCCac |
| 366 | 137 | GCAGGAGGGCUCACUCAAAtt | 744 | UUUGAGUGAGCCCUCCUGCca |
| 367 | 138 | CAGGAGGGCUCACUCAAAGtt | 745 | CUUUGAGUGAGCCCUCCUGcc |
| 368 | 139 | AGGAGGGCUCACUCAAAGCtt | 746 | GCUUUGAGUGAGCCCUCCUgc |
| 369 | 140 | GGAGGGCUCACUCAAAGCCtt | 747 | GGCUUUGAGUGAGCCCUCCtg |
| 370 | 141 | GAGGGCUCACUCAAAGCCUtt | 748 | AGGCUUUGAGUGAGCCCUCct |
| 371 | 142 | AGGGCUCACUCAAAGCCUCtt | 749 | GAGGCUUUGAGUGAGCCCUcc |
| 372 | 143 | GGGCUCACUCAAAGCCUCCtt | 750 | GGAGGCUUUGAGUGAGCCCtc |
| 373 | 144 | GGCUCACUCAAAGCCUCCUtt | 751 | AGGAGGCUUUGAGUGAGCCct |
| 374 | 145 | GCUCACUCAAAGCCUCCUGtt | 752 | CAGGAGGCUUUGAGUGAGCcc |
| 375 | 146 | CUCACUCAAAGCCUCCUGCtt | 753 | GCAGGAGGCUUUGAGUGAGcc |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
| --- | --- | --- | --- | --- |
| 376 | 147 | UCACUCAAAGCCUCCUGCCtt | 754 | GGCAGGAGGCUUUGAGUGAgc |
| 377 | 148 | CACUCAAAGCCUCCUGCCUtt | 755 | AGGCAGGAGGCUUUGAGUGag |
| 378 | 149 | ACUCAAAGCCUCCUGCCUAtt | 756 | UAGGCAGGAGGCUUUGAGUga |
| 379 | 150 | CUCAAAGCCUCCUGCCUAUtt | 757 | AUAGGCAGGAGGCUUUGAGtg |
| 380 | 151 | UCAAAGCCUCCUGCCUAUAtt | 758 | UAUAGGCAGGAGGCUUUGAgt |
| 381 | 152 | CAAAGCCUCCUGCCUAUACtt | 759 | GUAUAGGCAGGAGGCUUUGag |
| 382 | 153 | AAAGCCUCCUGCCUAUACGtt | 760 | CGUAUAGGCAGGAGGCUUUga |
| 383 | 154 | AAGCCUCCUGCCUAUACGGtt | 761 | CCGUAUAGGCAGGAGGCUUtg |
| 384 | 155 | AGCCUCCUGCCUAUACGGGtt | 762 | CCCGUAUAGGCAGGAGGCUtt |
| 385 | 156 | GCCUCCUGCCUAUACGGGCtt | 763 | GCCCGUAUAGGCAGGAGGCtt |
| 386 | 157 | CCUCCUGCCUAUACGGGCAtt | 764 | UGCCCGUAUAGGCAGGAGGct |
| 387 | 158 | CUCCUGCCUAUACGGGCAGtt | 765 | CUGCCCGUAUAGGCAGGAGgc |
| 388 | 159 | UCCUGCCUAUACGGGCAGCtt | 766 | GCUGCCCGUAUAGGCAGGAgg |
| 389 | 160 | CCUGCCUAUACGGGCAGCUtt | 767 | AGCUGCCCGUAUAGGCAGGag |
| 390 | 161 | CUGCCUAUACGGGCAGCUCtt | 768 | GAGCUGCCCGUAUAGGCAGga |
| 391 | 162 | UGCCUAUACGGGCAGCUCCtt | 769 | GGAGCUGCCCGUAUAGGCAgg |
| 392 | 163 | GCCUAUACGGGCAGCUCCCtt | 770 | GGGAGCUGCCCGUAUAGGCag |
| 409 | 164 | CCCAAGUUCCAGGACGGAGtt | 771 | CUCCGUCCUGGAACUUGGGga |
| 410 | 165 | CCAAGUUCCAGGACGGAGAtt | 772 | UCUCCGUCCUGGAACUUGGgg |
| 411 | 166 | CAAGUUCCAGGACGGAGACtt | 773 | GUCUCCGUCCUGGAACUUGgg |
| 412 | 167 | AAGUUCCAGGACGGAGACCtt | 774 | GGUCUCCGUCCUGGAACUUgg |
| 413 | 168 | AGUUCCAGGACGGAGACCUtt | 775 | AGGUCUCCGUCCUGGAACUtg |
| 414 | 169 | GUUCCAGGACGGAGACCUCtt | 776 | GAGGUCUCCGUCCUGGAACtt |
| 415 | 170 | UUCCAGGACGGAGACCUCAtt | 777 | UGAGGUCUCCGUCCUGGAAct |
| 416 | 171 | UCCAGGACGGAGACCUCACtt | 778 | GUGAGGUCUCCGUCCUGGAac |
| 417 | 172 | CCAGGACGGAGACCUCACCtt | 779 | GGUGAGGUCUCCGUCCUGGaa |
| 418 | 173 | CAGGACGGAGACCUCACCCtt | 780 | GGGUGAGGUCUCCGUCCUGga |
| 419 | 174 | AGGACGGAGACCUCACCCUtt | 781 | AGGGUGAGGUCUCCGUCCUgg |
| 420 | 175 | GGACGGAGACCUCACCCUGtt | 782 | CAGGGUGAGGUCUCCGUCCtg |
| 421 | 176 | GACGGAGACCUCACCCUGUtt | 783 | ACAGGGUGAGGUCUCCGUCct |
| 422 | 177 | ACGGAGACCUCACCCUGUAtt | 784 | UACAGGGUGAGGUCUCCGUcc |
| 423 | 178 | CGGAGACCUCACCCUGUACtt | 785 | GUACAGGGUGAGGUCUCCGtc |
| 424 | 179 | GGAGACCUCACCCUGUACCtt | 786 | GGUACAGGGUGAGGUCUCCgt |
| 425 | 180 | GAGACCUCACCCUGUACCAtt | 787 | UGGUACAGGGUGAGGUCUCcg |
| 426 | 181 | AGACCUCACCCUGUACCAGtt | 788 | CUGGUACAGGGUGAGGUCUcc |
| 427 | 182 | GACCUCACCCUGUACCAGUtt | 789 | ACUGGUACAGGGUGAGGUCtc |
| 428 | 183 | ACCUCACCCUGUACCAGUCtt | 790 | GACUGGUACAGGGUGAGGUct |
| 429 | 184 | CCUCACCCUGUACCAGUCCtt | 791 | GGACUGGUACAGGGUGAGGtc |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 430 | 185 | CUCACCCUGUACCAGUCCAtt | 792 | UGGACUGGUACAGGGUGAGgt |
| 431 | 186 | UCACCCUGUACCAGUCCAAtt | 793 | UUGGACUGGUACAGGGUGAgg |
| 432 | 187 | CACCCUGUACCAGUCCAAUtt | 794 | AUUGGACUGGUACAGGGUGag |
| 433 | 188 | ACCCUGUACCAGUCCAAUAtt | 795 | UAUUGGACUGGUACAGGGUga |
| 434 | 189 | CCCUGUACCAGUCCAAUACtt | 796 | GUAUUGGACUGGUACAGGGtg |
| 435 | 190 | CCUGUACCAGUCCAAUACCtt | 797 | GGUAUUGGACUGGUACAGGgt |
| 436 | 191 | CUGUACCAGUCCAAUACCAtt | 798 | UGGUAUUGGACUGGUACAGgg |
| 437 | 192 | UGUACCAGUCCAAUACCAUtt | 799 | AUGGUAUUGGACUGGUACAgg |
| 438 | 193 | GUACCAGUCCAAUACCAUCtt | 800 | GAUGGUAUUGGACUGGUACag |
| 439 | 194 | UACCAGUCCAAUACCAUCCtt | 801 | GGAUGGUAUUGGACUGGUAca |
| 440 | 195 | ACCAGUCCAAUACCAUCCUtt | 802 | AGGAUGGUAUUGGACUGGUac |
| 441 | 196 | CCAGUCCAAUACCAUCCUGtt | 803 | CAGGAUGGUAUUGGACUGGta |
| 442 | 197 | CAGUCCAAUACCAUCCUGCtt | 804 | GCAGGAUGGUAUUGGACUGgt |
| 443 | 198 | AGUCCAAUACCAUCCUGCGtt | 805 | CGCAGGAUGGUAUUGGACUgg |
| 444 | 199 | GUCCAAUACCAUCCUGCGUtt | 806 | ACGCAGGAUGGUAUUGGACtg |
| 445 | 200 | UCCAAUACCAUCCUGCGUCtt | 807 | GACGCAGGAUGGUAUUGGAct |
| 446 | 201 | CCAAUACCAUCCUGCGUCAtt | 808 | UGACGCAGGAUGGUAUUGGac |
| 447 | 202 | CAAUACCAUCCUGCGUCACtt | 809 | GUGACGCAGGAUGGUAUUGga |
| 448 | 203 | AAUACCAUCCUGCGUCACCtt | 810 | GGUGACGCAGGAUGGUAUUgg |
| 449 | 204 | AUACCAUCCUGCGUCACCUtt | 811 | AGGUGACGCAGGAUGGUAUtg |
| 450 | 205 | UACCAUCCUGCGUCACCUGtt | 812 | CAGGUGACGCAGGAUGGUAtt |
| 451 | 206 | ACCAUCCUGCGUCACCUGGtt | 813 | CCAGGUGACGCAGGAUGGUat |
| 452 | 207 | CCAUCCUGCGUCACCUGGGtt | 814 | CCCAGGUGACGCAGGAUGGta |
| 453 | 208 | CAUCCUGCGUCACCUGGGCtt | 815 | GCCCAGGUGACGCAGGAUGgt |
| 454 | 209 | AUCCUGCGUCACCUGGGCCtt | 816 | GGCCCAGGUGACGCAGGAUgg |
| 455 | 210 | UCCUGCGUCACCUGGGCCGtt | 817 | CGGCCCAGGUGACGCAGGAtg |
| 456 | 211 | CCUGCGUCACCUGGGCCGCtt | 818 | GCGGCCCAGGUGACGCAGGat |
| 457 | 212 | CUGCGUCACCUGGGCCGCAtt | 819 | UGCGGCCCAGGUGACGCAGga |
| 458 | 213 | UGCGUCACCUGGGCCGCACtt | 820 | GUGCGGCCCAGGUGACGCAgg |
| 459 | 214 | GCGUCACCUGGGCCGCACCtt | 821 | GGUGCGGCCCAGGUGACGCag |
| 460 | 215 | CGUCACCUGGGCCGCACCCtt | 822 | GGGUGCGGCCCAGGUGACGca |
| 461 | 216 | GUCACCUGGGCCGCACCCUtt | 823 | AGGGUGCGGCCCAGGUGACgc |
| 462 | 217 | UCACCUGGGCCGCACCCUUtt | 824 | AAGGGUGCGGCCCAGGUGAcg |
| 463 | 218 | CACCUGGGCCGCACCCUUGtt | 825 | CAAGGGUGCGGCCCAGGUGac |
| 464 | 219 | ACCUGGGCCGCACCCUUGGtt | 826 | CCAAGGGUGCGGCCCAGGUga |
| 465 | 220 | CCUGGGCCGCACCCUUGGGtt | 827 | CCCAAGGGUGCGGCCCAGGtg |
| 466 | 221 | CUGGGCCGCACCCUUGGGCtt | 828 | GCCCAAGGGUGCGGCCCAGgt |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 467 | 222 | UGGGCCGCACCCUUGGGCUtt | 829 | AGCCCAAGGGUGCGGCCCAgg |
| 468 | 223 | GGGCCGCACCCUUGGGCUCtt | 830 | GAGCCCAAGGGUGCGGCCCag |
| 469 | 224 | GGCCGCACCCUUGGGCUCUtt | 831 | AGAGCCCAAGGGUGCGGCCca |
| 470 | 225 | GCCGCACCCUUGGGCUCUAtt | 832 | UAGAGCCCAAGGGUGCGGCcc |
| 471 | 226 | CCGCACCCUUGGGCUCUAUtt | 833 | AUAGAGCCCAAGGGUGCGGcc |
| 472 | 227 | CGCACCCUUGGGCUCUAUGtt | 834 | CAUAGAGCCCAAGGGUGCGgc |
| 473 | 228 | GCACCCUUGGGCUCUAUGGtt | 835 | CCAUAGAGCCCAAGGGUGCgg |
| 474 | 229 | CACCCUUGGGCUCUAUGGGtt | 836 | CCCAUAGAGCCCAAGGGUGcg |
| 475 | 230 | ACCCUUGGGCUCUAUGGGAtt | 837 | UCCCAUAGAGCCCAAGGGUgc |
| 476 | 231 | CCCUUGGGCUCUAUGGGAAtt | 838 | UUCCCAUAGAGCCCAAGGGtg |
| 477 | 232 | CCUUGGGCUCUAUGGGAAGtt | 839 | CUUCCCAUAGAGCCCAAGGgt |
| 478 | 233 | CUUGGGCUCUAUGGGAAGGtt | 840 | CCUUCCCAUAGAGCCCAAGgg |
| 479 | 234 | UUGGGCUCUAUGGGAAGGAtt | 841 | UCCUUCCCAUAGAGCCCAAgg |
| 480 | 235 | UGGGCUCUAUGGGAAGGACtt | 842 | GUCCUUCCCAUAGAGCCCAag |
| 481 | 236 | GGGCUCUAUGGGAAGGACCtt | 843 | GGUCCUUCCCAUAGAGCCCaa |
| 482 | 237 | GGCUCUAUGGGAAGGACCAtt | 844 | UGGUCCUUCCCAUAGAGCCca |
| 483 | 238 | GCUCUAUGGGAAGGACCAGtt | 845 | CUGGUCCUUCCCAUAGAGCcc |
| 484 | 239 | CUCUAUGGGAAGGACCAGCtt | 846 | GCUGGUCCUUCCCAUAGAGcc |
| 485 | 240 | UCUAUGGGAAGGACCAGCAtt | 847 | UGCUGGUCCUUCCCAUAGAgc |
| 486 | 241 | CUAUGGGAAGGACCAGCAGtt | 848 | CUGCUGGUCCUUCCCAUAGag |
| 487 | 242 | UAUGGGAAGGACCAGCAGGtt | 849 | CCUGCUGGUCCUUCCCAUAga |
| 488 | 243 | AUGGGAAGGACCAGCAGGAtt | 850 | UCCUGCUGGUCCUUCCCAUag |
| 489 | 244 | UGGGAAGGACCAGCAGGAGtt | 851 | CUCCUGCUGGUCCUUCCCAta |
| 490 | 245 | GGGAAGGACCAGCAGGAGGtt | 852 | CCUCCUGCUGGUCCUUCCCat |
| 491 | 246 | GGAAGGACCAGCAGGAGGCtt | 853 | GCCUCCUGCUGGUCCUUCCca |
| 492 | 247 | GAAGGACCAGCAGGAGGCAtt | 854 | UGCCUCCUGCUGGUCCUUCcc |
| 493 | 248 | AAGGACCAGCAGGAGGCAGtt | 855 | CUGCCUCCUGCUGGUCCUUcc |
| 494 | 249 | AGGACCAGCAGGAGGCAGCtt | 856 | GCUGCCUCCUGCUGGUCCUtc |
| 495 | 250 | GGACCAGCAGGAGGCAGCCtt | 857 | GGCUGCCUCCUGCUGGUCCtt |
| 496 | 251 | GACCAGCAGGAGGCAGCCCtt | 858 | GGGCUGCCUCCUGCUGGUCct |
| 497 | 252 | ACCAGCAGGAGGCAGCCCUtt | 859 | AGGGCUGCCUCCUGCUGGUcc |
| 498 | 253 | CCAGCAGGAGGCAGCCCUGtt | 860 | CAGGGCUGCCUCCUGCUGGtc |
| 499 | 254 | CAGCAGGAGGCAGCCCUGGtt | 861 | CCAGGGCUGCCUCCUGCUGgt |
| 500 | 255 | AGCAGGAGGCAGCCCUGGUtt | 862 | ACCAGGGCUGCCUCCUGCUgg |
| 501 | 256 | GCAGGAGGCAGCCCUGGUGtt | 863 | CACCAGGGCUGCCUCCUGCtg |
| 502 | 257 | CAGGAGGCAGCCCUGGUGGtt | 864 | CCACCAGGGCUGCCUCCUGct |
| 503 | 258 | AGGAGGCAGCCCUGGUGGAtt | 865 | UCCACCAGGGCUGCCUCCUgc |
| 504 | 259 | GGAGGCAGCCCUGGUGGACtt | 866 | GUCCACCAGGGCUGCCUCCtg |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 505 | 260 | GAGGCAGCCCUGGUGGACAtt | 867 | UGUCCACCAGGGCUGCCUCct |
| 506 | 261 | AGGCAGCCCUGGUGGACAUtt | 868 | AUGUCCACCAGGGCUGCCUcc |
| 507 | 262 | GGCAGCCCUGGUGGACAUGtt | 869 | CAUGUCCACCAGGGCUGCCtc |
| 508 | 263 | GCAGCCCUGGUGGACAUGGtt | 870 | CCAUGUCCACCAGGGCUGCct |
| 509 | 264 | CAGCCCUGGUGGACAUGGUtt | 871 | ACCAUGUCCACCAGGGCUGcc |
| 510 | 265 | AGCCCUGGUGGACAUGGUGtt | 872 | CACCAUGUCCACCAGGGCUgc |
| 511 | 266 | GCCCUGGUGGACAUGGUGAtt | 873 | UCACCAUGUCCACCAGGGCtg |
| 512 | 267 | CCCUGGUGGACAUGGUGAAtt | 874 | UUCACCAUGUCCACCAGGGct |
| 513 | 268 | CCUGGUGGACAUGGUGAAUtt | 875 | AUUCACCAUGUCCACCAGGgc |
| 514 | 269 | CUGGUGGACAUGGUGAAUGtt | 876 | CAUUCACCAUGUCCACCAGgg |
| 515 | 270 | UGGUGGACAUGGUGAAUGAtt | 877 | UCAUUCACCAUGUCCACCAgg |
| 516 | 271 | GGUGGACAUGGUGAAUGACtt | 878 | GUCAUUCACCAUGUCCACCag |
| 517 | 272 | GUGGACAUGGUGAAUGACGtt | 879 | CGUCAUUCACCAUGUCCACca |
| 518 | 273 | UGGACAUGGUGAAUGACGGtt | 880 | CCGUCAUUCACCAUGUCCAcc |
| 519 | 274 | GGACAUGGUGAAUGACGGCtt | 881 | GCCGUCAUUCACCAUGUCCac |
| 520 | 275 | GACAUGGUGAAUGACGGCGtt | 882 | CGCCGUCAUUCACCAUGUCca |
| 521 | 276 | ACAUGGUGAAUGACGGCGUtt | 883 | ACGCCGUCAUUCACCAUGUcc |
| 522 | 277 | CAUGGUGAAUGACGGCGUGtt | 884 | CACGCCGUCAUUCACCAUGtc |
| 523 | 278 | AUGGUGAAUGACGGCGUGGtt | 885 | CCACGCCGUCAUUCACCAUgt |
| 524 | 279 | UGGUGAAUGACGGCGUGGAtt | 886 | UCCACGCCGUCAUUCACCAtg |
| 525 | 280 | GGUGAAUGACGGCGUGGAGtt | 887 | CUCCACGCCGUCAUUCACCat |
| 526 | 281 | GUGAAUGACGGCGUGGAGGtt | 888 | CCUCCACGCCGUCAUUCACca |
| 527 | 282 | UGAAUGACGGCGUGGAGGAtt | 889 | UCCUCCACGCCGUCAUUCAcc |
| 528 | 283 | GAAUGACGGCGUGGAGGACtt | 890 | GUCCUCCACGCCGUCAUUCac |
| 529 | 284 | AAUGACGGCGUGGAGGACCtt | 891 | GGUCCUCCACGCCGUCAUUca |
| 530 | 285 | AUGACGGCGUGGAGGACCUtt | 892 | AGGUCCUCCACGCCGUCAUtc |
| 531 | 286 | UGACGGCGUGGAGGACCUCtt | 893 | GAGGUCCUCCACGCCGUCAtt |
| 532 | 287 | GACGGCGUGGAGGACCUCCtt | 894 | GGAGGUCCUCCACGCCGUCat |
| 533 | 288 | ACGGCGUGGAGGACCUCCGtt | 895 | CGGAGGUCCUCCACGCCGUca |
| 534 | 289 | CGGCGUGGAGGACCUCCGCtt | 896 | GCGGAGGUCCUCCACGCCGtc |
| 535 | 290 | GGCGUGGAGGACCUCCGCUtt | 897 | AGCGGAGGUCCUCCACGCCgt |
| 536 | 291 | GCGUGGAGGACCUCCGCUGtt | 898 | CAGCGGAGGUCCUCCACGCcg |
| 537 | 292 | CGUGGAGGACCUCCGCUGCtt | 899 | GCAGCGGAGGUCCUCCACGcc |
| 538 | 293 | GUGGAGGACCUCCGCUGCAtt | 900 | UGCAGCGGAGGUCCUCCACgc |
| 539 | 294 | UGGAGGACCUCCGCUGCAAtt | 901 | UUGCAGCGGAGGUCCUCCAcg |
| 540 | 295 | GGAGGACCUCCGCUGCAAAtt | 902 | UUUGCAGCGGAGGUCCUCCac |
| 541 | 296 | GAGGACCUCCGCUGCAAAUtt | 903 | AUUUGCAGCGGAGGUCCUCca |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 542 | 297 | AGGACCUCCGCUGCAAAUAtt | 904 | UAUUUGCAGCGGAGGUCCUcc |
| 543 | 298 | GGACCUCCGCUGCAAAUACtt | 905 | GUAUUUGCAGCGGAGGUCCtc |
| 544 | 299 | GACCUCCGCUGCAAAUACAtt | 906 | UGUAUUUGCAGCGGAGGUCct |
| 545 | 300 | ACCUCCGCUGCAAAUACAUtt | 907 | AUGUAUUUGCAGCGGAGGUcc |
| 546 | 301 | CCUCCGCUGCAAAUACAUCtt | 908 | GAUGUAUUUGCAGCGGAGGtc |
| 547 | 302 | CUCCGCUGCAAAUACAUCUtt | 909 | AGAUGUAUUUGCAGCGGAgt |
| 548 | 303 | UCCGCUGCAAAUACAUCUCtt | 910 | GAGAUGUAUUUGCAGCGGAgg |
| 549 | 304 | CCGCUGCAAAUACAUCUCCtt | 911 | GGAGAUGUAUUUGCAGCGGag |
| 550 | 305 | CGCUGCAAAUACAUCUCCCtt | 912 | GGGAGAUGUAUUUGCAGCGga |
| 551 | 306 | GCUGCAAAUACAUCUCCCUtt | 913 | AGGGAGAUGUAUUUGCAGCgg |
| 552 | 307 | CUGCAAAUACAUCUCCCUCtt | 914 | GAGGGAGAUGUAUUUGCAGcg |
| 553 | 308 | UGCAAAUACAUCUCCCUCAtt | 915 | UGAGGGAGAUGUAUUUGCAgc |
| 554 | 309 | GCAAAUACAUCUCCCUCAUtt | 916 | AUGAGGGAGAUGUAUUUGCag |
| 555 | 310 | CAAAUACAUCUCCCUCAUCtt | 917 | GAUGAGGGAGAUGUAUUUGca |
| 556 | 311 | AAAUACAUCUCCCUCAUCUtt | 918 | AGAUGAGGGAGAUGUAUUUgc |
| 557 | 312 | AAUACAUCUCCCUCAUCUAtt | 919 | UAGAUGAGGGAGAUGUAUUtg |
| 558 | 313 | AUACAUCUCCCUCAUCUACtt | 920 | GUAGAUGAGGGAGAUGUAUtt |
| 559 | 314 | UACAUCUCCCUCAUCUACAtt | 921 | UGUAGAUGAGGGAGAUGUAtt |
| 560 | 315 | ACAUCUCCCUCAUCUACACtt | 922 | GUGUAGAUGAGGGAGAUGUat |
| 561 | 316 | CAUCUCCCUCAUCUACACCtt | 923 | GGUGUAGAUGAGGGAGAUGta |
| 562 | 317 | AUCUCCCUCAUCUACACCAtt | 924 | UGGUGUAGAUGAGGGAGAUgt |
| 563 | 318 | UCUCCCUCAUCUACACCAAtt | 925 | UUGGUGUAGAUGAGGGAGAtg |
| 563 | 319 | GCUCCCUCAUCUACACCAAtt | 926 | UUGGUGUAGAUGAGGGAGCtg |
| 564 | 320 | CUCCCUCAUCUACACCAACtt | 927 | GUUGGUGUAGAUGAGGGAGat |
| 565 | 321 | UCCCUCAUCUACACCAACUtt | 928 | AGUUGGUGUAGAUGAGGGAga |
| 565 | 322 | CUCCCUCAUCUACACCAAAtt | 929 | UUUGGUGUAGAUGAGGGAGat |
| 566 | 323 | CCCUCAUCUACACCAACUAtt | 930 | UAGUUGGUGUAGAUGAGGGag |
| 567 | 324 | CCUCAUCUACACCAACUAUtt | 931 | AUAGUUGGUGUAGAUGAGGga |
| 567 | 325 | CCUCAUCUACACCAACUAAtt | 932 | UUAGUUGGUGUAGAUGAGGga |
| 568 | 326 | CUCAUCUACACCAACUAUGtt | 933 | CAUAGUUGGUGUAGAUGAGgg |
| 569 | 327 | UCAUCUACACCAACUAUGAtt | 934 | UCAUAGUUGGUGUAGAUGAgg |
| 570 | 328 | CAUCUACACCAACUAUGAGtt | 935 | CUCAUAGUUGGUGUAGAUGag |
| 571 | 329 | AUCUACACCAACUAUGAGGtt | 936 | CCUCAUAGUUGGUGUAGAUga |
| 572 | 330 | UCUACACCAACUAUGAGGCtt | 937 | GCCUCAUAGUUGGUGUAGAtg |
| 573 | 331 | CUACACCAACUAUGAGGCGtt | 938 | CGCCUCAUAGUUGGUGUAGat |
| 574 | 332 | UACACCAACUAUGAGGCGGtt | 939 | CCGCCUCAUAGUUGGUGUAga |
| 575 | 333 | ACACCAACUAUGAGGCGGGtt | 940 | CCCGCCUCAUAGUUGGUGUag |
| 576 | 334 | CACCAACUAUGAGGCGGGCtt | 941 | GCCCGCCUCAUAGUUGGUGta |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 577 | 335 | ACCAACUAUGAGGCGGGCAtt | 942 | UGCCCGCCUCAUAGUUGGUgt |
| 578 | 336 | CCAACUAUGAGGCGGGCAAtt | 943 | UUGCCCGCCUCAUAGUUGGtg |
| 579 | 337 | CAACUAUGAGGCGGGCAAGtt | 944 | CUUGCCCGCCUCAUAGUUGgt |
| 580 | 338 | AACUAUGAGGCGGGCAAGGtt | 945 | CCUUGCCCGCCUCAUAGUUgg |
| 581 | 339 | ACUAUGAGGCGGGCAAGGAtt | 946 | UCCUUGCCCGCCUCAUAGUtg |
| 582 | 340 | CUAUGAGGCGGGCAAGGAUtt | 947 | AUCCUUGCCCGCCUCAUAGtt |
| 583 | 341 | UAUGAGGCGGGCAAGGAUGtt | 948 | CAUCCUUGCCCGCCUCAUAgt |
| 584 | 342 | AUGAGGCGGGCAAGGAUGAtt | 949 | UCAUCCUUGCCCGCCUCAUag |
| 585 | 343 | UGAGGCGGGCAAGGAUGACtt | 950 | GUCAUCCUUGCCCGCCUCAta |
| 586 | 344 | GAGGCGGGCAAGGAUGACUtt | 951 | AGUCAUCCUUGCCCGCCUCat |
| 587 | 345 | AGGCGGGCAAGGAUGACUAtt | 952 | UAGUCAUCCUUGCCCGCCUca |
| 588 | 346 | GGCGGGCAAGGAUGACUAUtt | 953 | AUAGUCAUCCUUGCCCGCCtc |
| 589 | 347 | GCGGGCAAGGAUGACUAUGtt | 954 | CAUAGUCAUCCUUGCCCGCct |
| 590 | 348 | CGGGCAAGGAUGACUAUGUtt | 955 | ACAUAGUCAUCCUUGCCCGcc |
| 591 | 349 | GGGCAAGGAUGACUAUGUGtt | 956 | CACAUAGUCAUCCUUGCCCgc |
| 592 | 350 | GGCAAGGAUGACUAUGUGAtt | 957 | UCACAUAGUCAUCCUUGCCcg |
| 593 | 351 | GCAAGGAUGACUAUGUGAAtt | 958 | UUCACAUAGUCAUCCUUGCcc |
| 594 | 352 | CAAGGAUGACUAUGUGAAGtt | 959 | CUUCACAUAGUCAUCCUUGcc |
| 595 | 353 | AAGGAUGACUAUGUGAAGGtt | 960 | CCUUCACAUAGUCAUCCUUgc |
| 596 | 354 | AGGAUGACUAUGUGAAGGCtt | 961 | GCCUUCACAUAGUCAUCCUtg |
| 597 | 355 | GGAUGACUAUGUGAAGGCAtt | 962 | UGCCUUCACAUAGUCAUCCtt |
| 598 | 356 | GAUGACUAUGUGAAGGCACtt | 963 | GUGCCUUCACAUAGUCAUCct |
| 599 | 357 | AUGACUAUGUGAAGGCACUtt | 964 | AGUGCCUUCACAUAGUCAUcc |
| 600 | 358 | UGACUAUGUGAAGGCACUGtt | 965 | CAGUGCCUUCACAUAGUCAtc |
| 601 | 359 | GACUAUGUGAAGGCACUGCtt | 966 | GCAGUGCCUUCACAUAGUCat |
| 602 | 360 | ACUAUGUGAAGGCACUGCCtt | 967 | GGCAGUGCCUUCACAUAGUca |
| 603 | 361 | CUAUGUGAAGGCACUGCCCtt | 968 | GGGCAGUGCCUUCACAUAGtc |
| 604 | 362 | UAUGUGAAGGCACUGCCCGtt | 969 | CGGGCAGUGCCUUCACAUAgt |
| 605 | 363 | AUGUGAAGGCACUGCCCGGtt | 970 | CCGGGCAGUGCCUUCACAUag |
| 606 | 364 | UGUGAAGGCACUGCCCGGGtt | 971 | CCCGGGCAGUGCCUUCACAta |
| 607 | 365 | GUGAAGGCACUGCCCGGGCtt | 972 | GCCCGGGCAGUGCCUUCACat |
| 608 | 366 | UGAAGGCACUGCCCGGGCAtt | 973 | UGCCCGGGCAGUGCCUUCAca |
| 609 | 367 | GAAGGCACUGCCCGGGCAAtt | 974 | UUGCCCGGGCAGUGCCUUCac |
| 610 | 368 | AAGGCACUGCCCGGGCAACtt | 975 | GUUGCCCGGGCAGUGCCUUca |
| 611 | 369 | AGGCACUGCCCGGGCAACUtt | 976 | AGUUGCCCGGGCAGUGCCUtc |
| 612 | 370 | GGCACUGCCCGGGCAACUGtt | 977 | CAGUUGCCCGGGCAGUGCCtt |
| 613 | 371 | GCACUGCCCGGGCAACUGAtt | 978 | UCAGUUGCCCGGGCAGUGCct |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 614 | 372 | CACUGCCCGGGCAACUGAAtt | 979 | UUCAGUUGCCCGGGCAGUGcc |
| 615 | 373 | ACUGCCCGGGCAACUGAAGtt | 980 | CUUCAGUUGCCCGGGCAGUgc |
| 616 | 374 | CUGCCCGGGCAACUGAAGCtt | 981 | GCUUCAGUUGCCCGGGCAGtg |
| 617 | 375 | UGCCCGGGCAACUGAAGCCtt | 982 | GGCUUCAGUUGCCCGGGCAgt |
| 618 | 376 | GCCCGGGCAACUGAAGCCUtt | 983 | AGGCUUCAGUUGCCCGGGCag |
| 619 | 377 | CCCGGGCAACUGAAGCCUUtt | 984 | AAGGCUUCAGUUGCCCGGGca |
| 620 | 378 | CCGGGCAACUGAAGCCUUUtt | 985 | AAAGGCUUCAGUUGCCCGGgc |
| 621 | 379 | CGGGCAACUGAAGCCUUUUtt | 986 | AAAAGGCUUCAGUUGCCCGgg |
| 622 | 380 | GGGCAACUGAAGCCUUUUGtt | 987 | CAAAAGGCUUCAGUUGCCCgg |
| 623 | 381 | GGCAACUGAAGCCUUUUGAtt | 988 | UCAAAAGGCUUCAGUUGCCcg |
| 624 | 382 | GCAACUGAAGCCUUUUGAGtt | 989 | CUCAAAAGGCUUCAGUUGCcc |
| 625 | 383 | CAACUGAAGCCUUUUGAGAtt | 990 | UCUCAAAAGGCUUCAGUUGcc |
| 626 | 384 | AACUGAAGCCUUUUGAGACtt | 991 | GUCUCAAAAGGCUUCAGUUgc |
| 627 | 385 | ACUGAAGCCUUUUGAGACCtt | 992 | GGUCUCAAAAGGCUUCAGUtg |
| 627 | 386 | ACUGAAGCCUUUUGAGACAtt | 993 | UGUCUCAAAAGGCUUCAGUtg |
| 628 | 387 | CUGAAGCCUUUUGAGACCCtt | 994 | GGGUCUCAAAAGGCUUCAGtt |
| 629 | 388 | UGAAGCCUUUUGAGACCCUtt | 995 | AGGGUCUCAAAAGGCUUCAgt |
| 630 | 389 | GAAGCCUUUUGAGACCCUGtt | 996 | CAGGGUCUCAAAAGGCUUCag |
| 631 | 390 | AAGCCUUUUGAGACCCUGCtt | 997 | GCAGGGUCUCAAAAGGCUUca |
| 631 | 391 | GAAGCCUUUUGAGACCCUAtt | 998 | UAGGGUCUCAAAAGGCUUCag |
| 632 | 392 | AGCCUUUUGAGACCCUGCUtt | 999 | AGCAGGGUCUCAAAAGGCUtc |
| 632 | 393 | CGCCUUUUGAGACCCUGCAtt | 1000 | UGCAGGGUCUCAAAAGGCGtc |
| 632 | 394 | AGCCUUUUGAGACCCUGCAtt | 1001 | UGCAGGGUCUCAAAAGGCUtc |
| 633 | 395 | GCCUUUUGAGACCCUGCUGtt | 1002 | CAGCAGGGUCUCAAAAGGCtt |
| 634 | 396 | CCUUUUGAGACCCUGCUGUtt | 1003 | ACAGCAGGGUCUCAAAAGGct |
| 634 | 397 | CCUUUUGAGACCCUGCUGAtt | 1004 | UCAGCAGGGUCUCAAAAGGct |
| 635 | 398 | CUUUUGAGACCCUGCUGUCtt | 1005 | GACAGCAGGGUCUCAAAAGgc |
| 635 | 399 | CUUUUGAGACCCUGCUGUAtt | 1006 | UACAGCAGGGUCUCAAAAGgc |
| 636 | 400 | UUUUGAGACCCUGCUGUCCtt | 1007 | GGACAGCAGGGUCUCAAAAgg |
| 637 | 401 | UUUGAGACCCUGCUGUCCCtt | 1008 | GGGACAGCAGGGUCUCAAAag |
| 638 | 402 | UUGAGACCCUGCUGUCCCAtt | 1009 | UGGGACAGCAGGGUCUCAAaa |
| 639 | 403 | UGAGACCCUGCUGUCCCAGtt | 1010 | CUGGGACAGCAGGGUCUCAaa |
| 640 | 404 | GAGACCCUGCUGUCCCAGAtt | 1011 | UCUGGGACAGCAGGGUCUCaa |
| 641 | 405 | AGACCCUGCUGUCCCAGAAtt | 1012 | UUCUGGGACAGCAGGGUCUca |
| 642 | 406 | GACCCUGCUGUCCCAGAACtt | 1013 | GUUCUGGGACAGCAGGGUCtc |
| 643 | 407 | ACCCUGCUGUCCCAGAACCtt | 1014 | GGUUCUGGGACAGCAGGGUct |
| 643 | 408 | ACCCUGCUGUCCCAGAACAtt | 1015 | UGUUCUGGGACAGCAGGGUct |
| 644 | 409 | CCCUGCUGUCCCAGAACCAtt | 1016 | UGGUUCUGGGACAGCAGGGtc |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 645 | 410 | CCUGCUGUCCCAGAACCAGtt | 1017 | CUGGUUCUGGGACAGCAGGgt |
| 646 | 411 | CUGCUGUCCCAGAACCAGGtt | 1018 | CCUGGUUCUGGGACAGCAGgg |
| 647 | 412 | UGCUGUCCCAGAACCAGGGtt | 1019 | CCCUGGUUCUGGGACAGCAgg |
| 648 | 413 | UGCUGUCCCAGAACCAGGAtt | 1020 | UCCUGGUUCUGGGACAGCAgg |
| 648 | 414 | GCUGUCCCAGAACCAGGGAtt | 1021 | UCCCUGGUUCUGGGACAGCag |
| 649 | 415 | CUGUCCCAGAACCAGGGAGtt | 1022 | CUCCCUGGUUCUGGGACAGca |
| 650 | 416 | UGUCCCAGAACCAGGGAGGtt | 1023 | CCUCCCUGGUUCUGGGACAgc |
| 651 | 417 | GUCCCAGAACCAGGGAGGCtt | 1024 | GCCUCCCUGGUUCUGGGACag |
| 652 | 418 | UCCCAGAACCAGGGAGGCAtt | 1025 | UGCCUCCCUGGUUCUGGGACa |
| 653 | 419 | CCCAGAACCAGGGAGGCAAtt | 1026 | UUGCCUCCCUGGUUCUGGGac |
| 654 | 420 | CCAGAACCAGGGAGGCAAGtt | 1027 | CUUGCCUCCCUGGUUCUGGga |
| 655 | 421 | CAGAACCAGGGAGGCAAGAtt | 1028 | UCUUGCCUCCCUGGUUCUGgg |
| 656 | 422 | AGAACCAGGGAGGCAAGACtt | 1029 | GUCUUGCCUCCCUGGUUCUgg |
| 657 | 423 | GAACCAGGGAGGCAAGACCtt | 1030 | GGUCUUGCCUCCCUGGUUCtg |
| 658 | 424 | AACCAGGGAGGCAAGACCUtt | 1031 | AGGUCUUGCCUCCCUGGUUct |
| 659 | 425 | ACCAGGGAGGCAAGACCUUtt | 1032 | AAGGUCUUGCCUCCCUGGUtc |
| 660 | 426 | CCAGGGAGGCAAGACCUUCtt | 1033 | GAAGGUCUUGCCUCCCUGGtt |
| 661 | 427 | CAGGGAGGCAAGACCUUCAtt | 1034 | UGAAGGUCUUGCCUCCCUGgt |
| 662 | 428 | AGGGAGGCAAGACCUUCAUtt | 1035 | AUGAAGGUCUUGCCUCCCUgg |
| 663 | 429 | GGGAGGCAAGACCUUCAUUtt | 1036 | AAUGAAGGUCUUGCCUCCCtg |
| 664 | 430 | GGAGGCAAGACCUUCAUUGtt | 1037 | CAAUGAAGGUCUUGCCUCCct |
| 665 | 431 | GAGGCAAGACCUUCAUUGUtt | 1038 | ACAAUGAAGGUCUUGCCUCcc |
| 666 | 432 | AGGCAAGACCUUCAUUGUGtt | 1039 | CACAAUGAAGGUCUUGCCUcc |
| 667 | 433 | GGCAAGACCUUCAUUGUGGtt | 1040 | CCACAAUGAAGGUCUUGCCtc |
| 668 | 434 | GCAAGACCUUCAUUGUGGGtt | 1041 | CCCACAAUGAAGGUCUUGCct |
| 669 | 435 | CAAGACCUUCAUUGUGGGAtt | 1042 | UCCCACAAUGAAGGUCUUGcc |
| 670 | 436 | AAGACCUUCAUUGUGGGAGtt | 1043 | CUCCCACAAUGAAGGUCUUgc |
| 671 | 437 | AGACCUUCAUUGUGGGAGAtt | 1044 | UCUCCCACAAUGAAGGUCUtg |
| 672 | 438 | GACCUUCAUUGUGGGAGACtt | 1045 | GUCUCCCACAAUGAAGGUCtt |
| 673 | 439 | ACCUUCAUUGUGGGAGACCtt | 1046 | GGUCUCCCACAAUGAAGGUct |
| 674 | 440 | CCUUCAUUGUGGGAGACCAtt | 1047 | UGGUCUCCCACAAUGAAGGtc |
| 675 | 441 | CUUCAUUGUGGGAGACCAGtt | 1048 | CUGGUCUCCCACAAUGAAGgt |
| 676 | 442 | UUCAUUGUGGGAGACCAGAtt | 1049 | UCUGGUCUCCCACAAUGAAgg |
| 677 | 443 | UCAUUGUGGGAGACCAGAUtt | 1050 | AUCUGGUCUCCCACAAUGAag |
| 678 | 444 | CAUUGUGGGAGACCAGAUCtt | 1051 | GAUCUGGUCUCCCACAAUGaa |
| 679 | 445 | AUUGUGGGAGACCAGAUCUtt | 1052 | AGAUCUGGUCUCCCACAAUga |
| 680 | 446 | UUGUGGGAGACCAGAUCUCtt | 1053 | GAGAUCUGGUCUCCCACAAtg |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 681 | 447 | UGUGGGAGACCAGAUCUCCtt | 1054 | GGAGAUCUGGUCUCCCACAat |
| 682 | 448 | GUGGGAGACCAGAUCUCCUtt | 1055 | AGGAGAUCUGGUCUCCCACaa |
| 683 | 449 | UGGGAGACCAGAUCUCCUUtt | 1056 | AAGGAGAUCUGGUCUCCCAca |
| 684 | 450 | GGGAGACCAGAUCUCCUUCtt | 1057 | GAAGGAGAUCUGGUCUCCCac |
| 685 | 451 | GGAGACCAGAUCUCCUUCGtt | 1058 | CGAAGGAGAUCUGGUCUCCca |
| 686 | 452 | GAGACCAGAUCUCCUUCGCtt | 1059 | GCGAAGGAGAUCUGGUCUCcc |
| 687 | 453 | AGACCAGAUCUCCUUCGCUtt | 1060 | AGCGAAGGAGAUCUGGUCUcc |
| 688 | 454 | GACCAGAUCUCCUUCGCUGtt | 1061 | CAGCGAAGGAGAUCUGGUCtc |
| 689 | 455 | ACCAGAUCUCCUUCGCUGAtt | 1062 | UCAGCGAAGGAGAUCUGGUct |
| 690 | 456 | CCAGAUCUCCUUCGCUGACtt | 1063 | GUCAGCGAAGGAGAUCUGGtc |
| 691 | 457 | CAGAUCUCCUUCGCUGACUtt | 1064 | AGUCAGCGAAGGAGAUCUGgt |
| 692 | 458 | AGAUCUCCUUCGCUGACUAtt | 1065 | UAGUCAGCGAAGGAGAUCUgg |
| 693 | 459 | GAUCUCCUUCGCUGACUACtt | 1066 | GUAGUCAGCGAAGGAGAUCtg |
| 694 | 460 | AUCUCCUUCGCUGACUACAtt | 1067 | UGUAGUCAGCGAAGGAGAUct |
| 695 | 461 | UCUCCUUCGCUGACUACAAtt | 1068 | UUGUAGUCAGCGAAGGAGAtc |
| 696 | 462 | CUCCUUCGCUGACUACAACtt | 1069 | GUUGUAGUCAGCGAAGGAGat |
| 697 | 463 | UCCUUCGCUGACUACAACCtt | 1070 | GGUUGUAGUCAGCGAAGGAga |
| 698 | 464 | CCUUCGCUGACUACAACCUtt | 1071 | AGGUUGUAGUCAGCGAAGGag |
| 699 | 465 | CUUCGCUGACUACAACCUGtt | 1072 | CAGGUUGUAGUCAGCGAAGga |
| 700 | 466 | UUCGCUGACUACAACCUGCtt | 1073 | GCAGGUUGUAGUCAGCGAAgg |
| 701 | 467 | UCGCUGACUACAACCUGCUtt | 1074 | AGCAGGUUGUAGUCAGCGAag |
| 702 | 468 | CGCUGACUACAACCUGCUGtt | 1075 | CAGCAGGUUGUAGUCAGCGaa |
| 703 | 469 | GCUGACUACAACCUGCUGGtt | 1076 | CCAGCAGGUUGUAGUCAGCga |
| 704 | 470 | CUGACUACAACCUGCUGGAtt | 1077 | UCCAGCAGGUUGUAGUCAGcg |
| 705 | 471 | UGACUACAACCUGCUGGACtt | 1078 | GUCCAGCAGGUUGUAGUCAgc |
| 706 | 472 | GACUACAACCUGCUGGACUtt | 1079 | AGUCCAGCAGGUUGUAGUCag |
| 707 | 473 | ACUACAACCUGCUGGACUUtt | 1080 | AAGUCCAGCAGGUUGUAGUca |
| 708 | 474 | CUACAACCUGCUGGACUUGtt | 1081 | CAAGUCCAGCAGGUUGUAGtc |
| 709 | 475 | UACAACCUGCUGGACUUGCtt | 1082 | GCAAGUCCAGCAGGUUGUAgt |
| 710 | 476 | ACAACCUGCUGGACUUGCUtt | 1083 | AGCAAGUCCAGCAGGUUGUag |
| 711 | 477 | CAACCUGCUGGACUUGCUGtt | 1084 | CAGCAAGUCCAGCAGGUUGta |
| 712 | 478 | AACCUGCUGGACUUGCUGCtt | 1085 | GCAGCAAGUCCAGCAGGUUgt |
| 713 | 479 | ACCUGCUGGACUUGCUGCUtt | 1086 | AGCAGCAAGUCCAGCAGGUtg |
| 714 | 480 | CCUGCUGGACUUGCUGCUGtt | 1087 | CAGCAGCAAGUCCAGCAGGtt |
| 715 | 481 | CUGCUGGACUUGCUGCUGAtt | 1088 | UCAGCAGCAAGUCCAGCAGgt |
| 716 | 482 | UGCUGGACUUGCUGCUGAUtt | 1089 | AUCAGCAGCAAGUCCAGCAgg |
| 717 | 483 | GCUGGACUUGCUGCUGAUCtt | 1090 | GAUCAGCAGCAAGUCCAGCag |
| 718 | 484 | CUGGACUUGCUGCUGAUCCtt | 1091 | GGAUCAGCAGCAAGUCCAGca |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 719 | 485 | UGGACUUGCUGCUGAUCCAtt | 1092 | UGGAUCAGCAGCAAGUCCAgc |
| 720 | 486 | GGACUUGCUGCUGAUCCAUtt | 1093 | AUGGAUCAGCAGCAAGUCCag |
| 721 | 487 | GACUUGCUGCUGAUCCAUGtt | 1094 | CAUGGAUCAGCAGCAAGUCca |
| 722 | 488 | ACUUGCUGCUGAUCCAUGAtt | 1095 | UCAUGGAUCAGCAGCAAGUcc |
| 723 | 489 | CUUGCUGCUGAUCCAUGAGtt | 1096 | CUCAUGGAUCAGCAGCAAGtc |
| 724 | 490 | UUGCUGCUGAUCCAUGAGGtt | 1097 | CCUCAUGGAUCAGCAGCAAgt |
| 725 | 491 | UGCUGCUGAUCCAUGAGGUtt | 1098 | ACCUCAUGGAUCAGCAGCAag |
| 726 | 492 | GCUGCUGAUCCAUGAGGUCtt | 1099 | GACCUCAUGGAUCAGCAGCaa |
| 727 | 493 | CUGCUGAUCCAUGAGGUCCtt | 1100 | GGACCUCAUGGAUCAGCAGca |
| 728 | 494 | UGCUGAUCCAUGAGGUCCUtt | 1101 | AGGACCUCAUGGAUCAGCAgc |
| 729 | 495 | GCUGAUCCAUGAGGUCCUAtt | 1102 | UAGGACCUCAUGGAUCAGCag |
| 730 | 496 | CUGAUCCAUGAGGUCCUAGtt | 1103 | CUAGGACCUCAUGGAUCAGca |
| 731 | 497 | UGAUCCAUGAGGUCCUAGCtt | 1104 | GCUAGGACCUCAUGGAUCAgc |
| 732 | 498 | GAUCCAUGAGGUCCUAGCCtt | 1105 | GGCUAGGACCUCAUGGAUCag |
| 733 | 499 | AUCCAUGAGGUCCUAGCCCtt | 1106 | GGGCUAGGACCUCAUGGAUca |
| 750 | 500 | CCCUGGCUGCCUGGAUGCGtt | 1107 | CGCAUCCAGGCAGCCAGGGgc |
| 751 | 501 | CCUGGCUGCCUGGAUGCGUtt | 1108 | ACGCAUCCAGGCAGCCAGGgg |
| 752 | 502 | CUGGCUGCCUGGAUGCGUUtt | 1109 | AACGCAUCCAGGCAGCCAGgg |
| 753 | 503 | UGGCUGCCUGGAUGCGUUCtt | 1110 | GAACGCAUCCAGGCAGCCAgg |
| 754 | 504 | GGCUGCCUGGAUGCGUUCCtt | 1111 | GGAACGCAUCCAGGCAGCCag |
| 755 | 505 | GCUGCCUGGAUGCGUUCCCtt | 1112 | GGGAACGCAUCCAGGCAGCca |
| 773 | 506 | CCCUGCUCUCAGCAUAUGUtt | 1113 | ACAUAUGCUGAGAGCAGGGgg |
| 774 | 507 | CCUGCUCUCAGCAUAUGUGtt | 1114 | CACAUAUGCUGAGAGCAGGgg |
| 775 | 508 | CUGCUCUCAGCAUAUGUGGtt | 1115 | CCACAUAUGCUGAGAGCAGgg |
| 776 | 509 | UGCUCUCAGCAUAUGUGGGtt | 1116 | CCCACAUAUGCUGAGAGCAgg |
| 793 | 510 | GGGCGCCUCAGUGCCCGGCtt | 1117 | GCCGGGCACUGAGGCGCCCca |
| 794 | 511 | GGCGCCUCAGUGCCCGGCCtt | 1118 | GGCCGGGCACUGAGGCGCCcc |
| 795 | 512 | GCGCCUCAGUGCCCGGCCCtt | 1119 | GGGCCGGGCACUGAGGCGCcc |
| 796 | 513 | CGCCUCAGUGCCCGGCCCAtt | 1120 | UGGGCCGGGCACUGAGGCGcc |
| 797 | 514 | GCCUCAGUGCCCGGCCCAAtt | 1121 | UUGGGCCGGGCACUGAGGCgc |
| 798 | 515 | CCUCAGUGCCCGGCCCAAGtt | 1122 | CUUGGGCCGGGCACUGAGGcg |
| 799 | 516 | CUCAGUGCCCGGCCCAAGCtt | 1123 | GCUUGGGCCGGGCACUGAGgc |
| 800 | 517 | UCAGUGCCCGGCCCAAGCUtt | 1124 | AGCUUGGGCCGGGCACUGAgg |
| 801 | 518 | CAGUGCCCGGCCCAAGCUCtt | 1125 | GAGCUUGGGCCGGGCACUGag |
| 802 | 519 | AGUGCCCGGCCCAAGCUCAtt | 1126 | UGAGCUUGGGCCGGGCACUga |
| 803 | 520 | GUGCCCGGCCCAAGCUCAAtt | 1127 | UUGAGCUUGGGCCGGGCACtg |
| 804 | 521 | UGCCCGGCCCAAGCUCAAGtt | 1128 | CUUGAGCUUGGGCCGGGCAct |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 805 | 522 | GCCCGGCCCAAGCUCAAGGtt | 1129 | CCUUGAGCUUGGGCCGGGCac |
| 806 | 523 | CCCGGCCCAAGCUCAAGGCtt | 1130 | GCCUUGAGCUUGGGCCGGGca |
| 807 | 524 | CCGGCCCAAGCUCAAGGCCtt | 1131 | GGCCUUGAGCUUGGGCCGGgc |
| 808 | 525 | CGGCCCAAGCUCAAGGCCUtt | 1132 | AGGCCUUGAGCUUGGGCCGgg |
| 809 | 526 | GGCCCAAGCUCAAGGCCUUtt | 1133 | AAGGCCUUGAGCUUGGGCCgg |
| 810 | 527 | GCCCAAGCUCAAGGCCUUCtt | 1134 | GAAGGCCUUGAGCUUGGGCcg |
| 811 | 528 | CCCAAGCUCAAGGCCUUCCtt | 1135 | GGAAGGCCUUGAGCUUGGGcc |
| 812 | 529 | CCAAGCUCAAGGCCUUCCUtt | 1136 | AGGAAGGCCUUGAGCUUGGgc |
| 813 | 530 | CAAGCUCAAGGCCUUCCUGtt | 1137 | CAGGAAGGCCUUGAGCUUGgg |
| 814 | 531 | AAGCUCAAGGCCUUCCUGGtt | 1138 | CCAGGAAGGCCUUGAGCUUgg |
| 815 | 532 | AGCUCAAGGCCUUCCUGGCtt | 1139 | GCCAGGAAGGCCUUGAGCUtg |
| 816 | 533 | GCUCAAGGCCUUCCUGGCCtt | 1140 | GGCCAGGAAGGCCUUGAGCtt |
| 817 | 534 | CUCAAGGCCUUCCUGGCCUtt | 1141 | AGGCCAGGAAGGCCUUGAGct |
| 818 | 535 | UCAAGGCCUUCCUGGCCUCtt | 1142 | GAGGCCAGGAAGGCCUUGAgc |
| 819 | 536 | CAAGGCCUUCCUGGCCUCCtt | 1143 | GGAGGCCAGGAAGGCCUUGag |
| 820 | 537 | AAGGCCUUCCUGGCCUCCCtt | 1144 | GGGAGGCCAGGAAGGCCUUga |
| 837 | 538 | CCCUGAGUACGUGAACCUCtt | 1145 | GAGGUUCACGUACUCAGGGga |
| 838 | 539 | CCUGAGUACGUGAACCUCCtt | 1146 | GGAGGUUCACGUACUCAGGgg |
| 839 | 540 | CUGAGUACGUGAACCUCCCtt | 1147 | GGGAGGUUCACGUACUCAGgg |
| 856 | 541 | CCCAUCAAUGGCAACGGGAtt | 1148 | UCCCGUUGCCAUUGAUGGGga |
| 857 | 542 | CCAUCAAUGGCAACGGGAAtt | 1149 | UUCCCGUUGCCAUUGAUGGgg |
| 858 | 543 | CAUCAAUGGCAACGGGAAAtt | 1150 | UUUCCCGUUGCCAUUGAUGgg |
| 859 | 544 | AUCAAUGGCAACGGGAAACtt | 1151 | GUUUCCCGUUGCCAUUGAUgg |
| 860 | 545 | UCAAUGGCAACGGGAAACAtt | 1152 | UGUUUCCCGUUGCCAUUGAtg |
| 861 | 546 | CAAUGGCAACGGGAAACAGtt | 1153 | CUGUUUCCCGUUGCCAUUGat |
| 862 | 547 | AAUGGCAACGGGAAACAGUtt | 1154 | ACUGUUUCCCGUUGCCAUUga |
| 863 | 548 | AUGGCAACGGGAAACAGUGtt | 1155 | CACUGUUUCCCGUUGCCAUtg |
| 864 | 549 | UGGCAACGGGAAACAGUGAtt | 1156 | UCACUGUUUCCCGUUGCCAtt |
| 865 | 550 | GGCAACGGGAAACAGUGAGtt | 1157 | CUCACUGUUUCCCGUUGCcat |
| 866 | 551 | GCAACGGGAAACAGUGAGGtt | 1158 | CCUCACUGUUUCCCGUUGCca |
| 867 | 552 | CAACGGGAAACAGUGAGGGtt | 1159 | CCCUCACUGUUUCCCGUUGcc |
| 868 | 553 | AACGGGAAACAGUGAGGGUtt | 1160 | ACCCUCACUGUUUCCCGUUgc |
| 869 | 554 | ACGGGAAACAGUGAGGGUUtt | 1161 | AACCCUCACUGUUUCCCGUtg |
| 870 | 555 | CGGGAAACAGUGAGGGUUGtt | 1162 | CAACCCUCACUGUUUCCCGtt |
| 871 | 556 | GGGAAACAGUGAGGGUUGGtt | 1163 | CCAACCCUCACUGUUUCCCgt |
| 872 | 557 | GGAAACAGUGAGGGUUGGGtt | 1164 | CCCAACCCUCACUGUUUCCcg |
| 891 | 558 | GGGACUCUGAGCGGGAGGCtt | 1165 | GCCUCCCGCUCAGAGUCCCcc |
| 892 | 559 | GGACUCUGAGCGGGAGGCAtt | 1166 | UGCCUCCCGCUCAGAGUCCcc |

TABLE 1-continued

RNAi molecule sequences for GST-π

| Ref Pos | SEQ ID NO | SENSE STRAND (5' --> 3') SEQ ID NOS: 2 to 608 | SEQ ID NO | ANTISENSE STRAND (5' --> 3') SEQ ID NOS: 609 to 1215 |
|---|---|---|---|---|
| 894 | 560 | ACUCUGAGCGGGAGGCAGAtt | 1167 | UCUGCCUCCCGCUCAGAGUcc |
| 896 | 561 | UCUGAGCGGGAGGCAGAGUtt | 1168 | ACUCUGCCUCCCGCUCAGAgt |
| 897 | 562 | CUGAGCGGGAGGCAGAGUUtt | 1169 | AACUCUGCCUCCCGCUCAGag |
| 898 | 563 | UGAGCGGGAGGCAGAGUUUtt | 1170 | AAACUCUGCCUCCCGCUCAga |
| 899 | 564 | GAGCGGGAGGCAGAGUUUGtt | 1171 | CAAACUCUGCCUCCCGCUCag |
| 900 | 565 | AGCGGGAGGCAGAGUUUGCtt | 1172 | GCAAACUCUGCCUCCCGCUca |
| 901 | 566 | GCGGGAGGCAGAGUUUGCCtt | 1173 | GGCAAACUCUGCCUCCCGCtc |
| 902 | 567 | CGGGAGGCAGAGUUUGCCUtt | 1174 | AGGCAAACUCUGCCUCCCGct |
| 903 | 568 | GGGAGGCAGAGUUUGCCUUtt | 1175 | AAGGCAAACUCUGCCUCCCgc |
| 904 | 569 | GGAGGCAGAGUUUGCCUUCtt | 1176 | GAAGGCAAACUCUGCCUCCcg |
| 905 | 570 | GAGGCAGAGUUUGCCUUCCtt | 1177 | GGAAGGCAAACUCUGCCUCcc |
| 906 | 571 | AGGCAGAGUUUGCCUUCCUtt | 1178 | AGGAAGGCAAACUCUGCCUcc |
| 907 | 572 | GGCAGAGUUUGCCUUCCUUtt | 1179 | AAGGAAGGCAAACUCUGCCtc |
| 908 | 573 | GCAGAGUUUGCCUUCCUUUtt | 1180 | AAAGGAAGGCAAACUCUGCct |
| 909 | 574 | CAGAGUUUGCCUUCCUUUCtt | 1181 | GAAAGGAAGGCAAACUCUGcc |
| 910 | 575 | AGAGUUUGCCUUCCUUUCUtt | 1182 | AGAAAGGAAGGCAAACUCUgc |
| 911 | 576 | GAGUUUGCCUUCCUUUCUCtt | 1183 | GAGAAAGGAAGGCAAACUCtg |
| 912 | 577 | AGUUUGCCUUCCUUUCUCCtt | 1184 | GGAGAAAGGAAGGCAAACUct |
| 913 | 578 | GUUUGCCUUCCUUUCUCCAtt | 1185 | UGGAGAAAGGAAGGCAAACtc |
| 914 | 579 | UUUGCCUUCCUUUCUCCAGtt | 1186 | CUGGAGAAAGGAAGGCAAAct |
| 915 | 580 | UUGCCUUCCUUUCUCCAGGtt | 1187 | CCUGGAGAAAGGAAGGCAAac |
| 916 | 581 | UGCCUUCCUUUCUCCAGGAtt | 1188 | UCCUGGAGAAAGGAAGGCAaa |
| 917 | 582 | GCCUUCCUUUCUCCAGGACtt | 1189 | GUCCUGGAGAAAGGAAGGCaa |
| 918 | 583 | CCUUCCUUUCUCCAGGACCtt | 1190 | GGUCCUGGAGAAAGGAAGGca |
| 919 | 584 | CUUCCUUUCUCCAGGACCAtt | 1191 | UGGUCCUGGAGAAAGGAAGgc |
| 920 | 585 | UUCCUUUCUCCAGGACCAAtt | 1192 | UUGGUCCUGGAGAAAGGAAgg |
| 921 | 586 | UCCUUUCUCCAGGACCAAUtt | 1193 | AUUGGUCCUGGAGAAAGGAag |
| 922 | 587 | CCUUUCUCCAGGACCAAUAtt | 1194 | UAUUGGUCCUGGAGAAAGGaa |
| 923 | 588 | CUUUCUCCAGGACCAAUAAtt | 1195 | UUAUUGGUCCUGGAGAAAGga |
| 924 | 589 | UUUCUCCAGGACCAAUAAAtt | 1196 | UUUAUUGGUCCUGGAGAAAgg |
| 925 | 590 | UUCUCCAGGACCAAUAAAAtt | 1197 | UUUUAUUGGUCCUGGAGAAag |
| 926 | 591 | UCUCCAGGACCAAUAAAAUtt | 1198 | AUUUUAUUGGUCCUGGAGAaa |
| 927 | 592 | CUCCAGGACCAAUAAAAUUtt | 1199 | AAUUUUAUUGGUCCUGGAGaa |
| 928 | 593 | UCCAGGACCAAUAAAAUUUtt | 1200 | AAAUUUUAUUGGUCCUGGAga |
| 929 | 594 | CCAGGACCAAUAAAAUUUCtt | 1201 | GAAAUUUUAUUGGUCCUGGag |
| 930 | 595 | CAGGACCAAUAAAAUUUCUtt | 1202 | AGAAAUUUUAUUGGUCCUGga |
| 931 | 596 | AGGACCAAUAAAAUUUCUAtt | 1203 | UAGAAAUUUUAUUGGUCCUgg |

TABLE 1-continued

RNAi molecule sequences for GST-π

| Ref Pos | SEQ ID NO SEQ ID NOS: 2 to 608 | SENSE STRAND (5' --> 3') | SEQ ID NO SEQ ID NOS: 609 to 1215 | ANTISENSE STRAND (5' --> 3') |
|---|---|---|---|---|
| 932 | 597 | GGACCAAUAAAAUUUCUAAtt | 1204 | UUAGAAAUUUUAUUGGUCCtg |
| 933 | 598 | GACCAAUAAAAUUUCUAAGtt | 1205 | CUUAGAAAUUUUAUUGGUCct |
| 934 | 599 | ACCAAUAAAAUUUCUAAGAtt | 1206 | UCUUAGAAAUUUUAUUGGUcc |
| 935 | 600 | CCAAUAAAAUUUCUAAGAGtt | 1207 | CUCUUAGAAAUUUUAUUGGtc |
| 936 | 601 | CAAUAAAAUUUCUAAGAGAtt | 1208 | UCUCUUAGAAAUUUUAUUGgt |
| 937 | 602 | AAUAAAAUUUCUAAGAGAGtt | 1209 | CUCUCUUAGAAAUUUUAUUgg |
| 938 | 603 | AUAAAAUUUCUAAGAGAGCtt | 1210 | GCUCUCUUAGAAAUUUUAUtg |
| 939 | 604 | UAAAAUUUCUAAGAGAGCUtt | 1211 | AGCUCUCUUAGAAAUUUUAtt |
| 940 | 605 | AAAAUUUCUAAGAGAGCUAtt | 1212 | UAGCUCUCUUAGAAAUUUUat |
| 941 | 606 | AAAUUUCUAAGAGAGCUAAtt | 1213 | UUAGCUCUCUUAGAAAUUUta |
| 942 | 607 | AAUUUCUAAGAGAGCUAAAtt | 1214 | UUUAGCUCUCUUAGAAAUUtt |
| 943 | 608 | AUUUCUAAGAGAGCUAAAAtt | 1215 | UUUUAGCUCUCUUAGAAAUtt |

Key for Table 1: Upper case A, G, C and U referred to for ribo-A, ribo-G, ribo-C and ribo-U respectively. The lower case letters a, g, c, t represent 2'-deoxy-A, 2'-deoxy-G, 2'-deoxy-C and thymidine respectively.

Examples of RNAi molecules of this invention targeted to GST-π mRNA are shown in Table 2.

TABLE 2

RNAi molecule sequences for GST-π

| ID | Ref Pos | SEQ ID NO SEQ ID NOS: 1216 to 1280 | SENSE STRAND (5'-->3') | SEQ ID NO SEQ ID NOS: 1281 to 1345 | ANTISENSE STRAND (5'-->3') |
|---|---|---|---|---|---|
| A1  | 652 | 1216 | UCCCAGAACCAGGGAGGCAtt | 1281 | UGCCUCCCUGGUUCUGGGAca |
| A10 | 635 | 1217 | CUUUUGAGACCCUGCUGUCtt | 1282 | GACAGCAGGGUCUCAAAAGgc |
| A11 | 649 | 1218 | CUGUCCCAGAACCAGGGAGtt | 1283 | CUCCCUGGUUCUGGGACAGca |
| A12 | 650 | 1219 | UGUCCCAGAACCAGGGAGGtt | 1284 | CCUCCCUGGUUCUGGGACAgc |
| A13 | 631 | 1220 | AAGCCUUUUGAGACCCUGCtt | 1285 | GCAGGGUCUCAAAAGGCUUca |
| A14 | 638 | 1221 | UUGAGACCCUGCUGUCCCAtt | 1286 | UGGGACAGCAGGGUCUCAAaa |
| A15 | 636 | 1222 | UUUUGAGACCCUGCUGUCCtt | 1287 | GGACAGCAGGGUCUCAAAAgg |
| A16 | 640 | 1223 | GAGACCCUGCUGUCCCAGAtt | 1288 | UCUGGGACAGCAGGGUCUCaa |
| A17 | 332 | 1224 | GCUGGAAGGAGGAGGUGGUtt | 1289 | ACCACCUCCUCCUUCCAGCtc |
| A18 | 333 | 1225 | CUGGAAGGAGGAGGUGGUGtt | 1290 | CACCACCUCCUCCUUCCAGct |
| A19 | 321 | 1226 | UCAGGGCCAGAGCUGGAAGtt | 1291 | CUUCCAGCUCUGGCCCUGAtc |
| A2  | 639 | 1227 | UGAGACCCUGCUGUCCCAGtt | 1292 | CUGGGACAGCAGGGUCUCAaa |
| A20 | 323 | 1228 | AGGGCCAGAGCUGGAAGGAtt | 1293 | UCCUUCCAGCUCUGGCCCUga |
| A21 | 331 | 1229 | AGCUGGAAGGAGGAGGUGGtt | 1294 | CCACCUCCUCCUUCCAGCUct |
| A22 | 641 | 1230 | AGACCCUGCUGUCCCAGAAtt | 1295 | UUCUGGGACAGCAGGGUCUca |
| A23 | 330 | 1231 | GAGCUGGAAGGAGGAGGUGtt | 1296 | CACCUCCUCCUUCCAGCUCtg |
| A25 | 647 | 1232 | UGCUGUCCCAGAACCAGGGtt | 1297 | CCCUGGUUCUGGGACAGCAgg |

TABLE 2 -continued

RNAi molecule sequences for GST-π

| ID | Ref Pos | SEQ ID NO SEQ ID NOS: 1216 to 1280 | SENSE STRAND (5'-->3') | SEQ ID NO SEQ ID NOS: 1281 to 1345 | ANTISENSE STRAND (5'-->3') |
|---|---|---|---|---|---|
| A26 | 653 | 1233 | CCCAGAACCAGGGAGGCAAtt | 1298 | UUGCCUCCCUGGUUCUGGGac |
| A3 | 654 | 1234 | CCAGAACCAGGGAGGCAAGtt | 1299 | CUUGCCUCCCUGGUUCUGGGa |
| A4 | 637 | 1235 | UUUGAGACCCUGCUGUCCCtt | 1300 | GGGACAGCAGGGUCUCAAAag |
| A5 | 642 | 1236 | GACCCUGCUGUCCCAGAACtt | 1301 | GUUCUGGGACAGCAGGGUCtc |
| A6 | 319 | 1237 | GAUCAGGGCCAGAGCUGGAtt | 1302 | UCCAGCUCUGGCCCUGAUCtg |
| A7 | 632 | 1238 | AGCCUUUUGAGACCCUGCUtt | 1303 | AGCAGGGUCUCAAAAGGCUtc |
| A8 | 633 | 1239 | GCCUUUUGAGACCCUGCUGtt | 1304 | CAGCAGGGUCUCAAAAGGCtt |
| A9 | 634 | 1240 | CCUUUUGAGACCCUGCUGUtt | 1305 | ACAGCAGGGUCUCAAAAGGct |
| AG7 | 632 | 1241 | CGCCUUUUGAGACCCUGCAtt | 1306 | UGCAGGGUCUCAAAAGGCGtc |
| AK1 | 257 | 1242 | CCUACACCGUGGUCUAUUUtt | 1307 | AAAUAGACCACGGUGUAGGgc |
| AK10 | 681 | 1243 | UGUGGGAGACCAGAUCUCCtt | 1308 | GGAGAUCUGGUCUCCCACAat |
| AK11 | 901 | 1244 | GCGGGAGGCAGAGUUUGCCtt | 1309 | GGCAAACUCUGCCUCCCGCtc |
| AK12 | 922 | 1245 | CCUUUCUCCAGGACCAAUAtt | 1310 | UAUUGGUCCUGGAGAAAGGaa |
| AK13/A24 | 643 | 1246 | ACCCUGCUGUCCCAGAACCtt | 1311 | GGUUCUGGGACAGCAGGGUct |
| AK2 | 267 | 1247 | GGUCUAUUUCCCAGUUCGAtt | 1312 | UCGAACUGGGAAAUAGACCac |
| AK3 | 512 | 1248 | CCCUGGUGGACAUGGUGAAtt | 1313 | UUCACCAUGUCCACCAGGGct |
| AK4 | 560 | 1249 | ACAUCUCCCUCAUCUACACtt | 1314 | GUGUAGAUGAGGGAGAUGUat |
| AK5 | 593 | 1250 | GCAAGGAUGACUAUGUGAAtt | 1315 | UUCACAUAGUCAUCCUUGCcc |
| AK6 | 698 | 1251 | CCUUCGCUGACUACAACCUtt | 1316 | AGGUUGUAGUCAGCGAAGGag |
| AK7 | 313 | 1252 | CUGGCAGAUCAGGGCCAGAtt | 1317 | UCUGGCCCUGAUCUGCCAGca |
| AK8 | 421 | 1253 | GACGGAGACCUCACCCUGUtt | 1318 | ACAGGGUGAGGUCUCCGUCct |
| AK9 | 590 | 1254 | CGGGCAAGGAUGACUAUGUtt | 1319 | ACAUAGUCAUCCUUGCCCgcc |
| AU10 | 635 | 1255 | CUUUUGAGACCCUGCUGUAtt | 1320 | UACAGCAGGGUCUCAAAAGgc |
| AU23 | 330 | 1256 | GAGCUGGAAGGAGGAGGUAtt | 1321 | UACCUCCUCCUUCCAGCUCtg |
| AU24 | 643 | 1257 | ACCCUGCUGUCCCAGAACAtt | 1322 | UGUUCUGGGACAGCAGGGUct |
| AU25 | 648 | 1258 | UGCUGUCCCAGAACCAGGAtt | 1323 | UCCUGGUUCUGGGACAGCAgg |
| AU7 | 632 | 1259 | AGCCUUUUGAGACCCUGCAtt | 1324 | UGCAGGGUCUCAAAAGGCUtc |
| AU9 | 634 | 1260 | CCUUUUGAGACCCUGCUGAtt | 1325 | UCAGCAGGGUCUCAAAAGGct |
| B1 | 629 | 1261 | UGAAGCCUUUUGAGACCCUtt | 1326 | AGGGUCUCAAAAGGCUUCAgt |
| B10 | 627 | 1262 | ACUGAAGCCUUUUGAGACCtt | 1327 | GGUCUCAAAAGGCUUCAGUtg |
| B11 | 595 | 1263 | AAGGAUGACUAUGUGAAGGtt | 1328 | CCUUCACAUAGUCAUCCUUgc |
| B12 | 596 | 1264 | AGGAUGACUAUGUGAAGGCtt | 1329 | GCCUUCACAUAGUCAUCCUtg |
| B13 | 597 | 1265 | GGAUGACUAUGUGAAGGCAtt | 1330 | UGCCUUCACAUAGUCAUCCtt |
| B14 | 564 | 1266 | CUCCCUCAUCUACACCAACtt | 1331 | GUUGGUGUAGAUGAGGGAGat |
| B2 | 630 | 1267 | GAAGCCUUUUGAGACCCUGtt | 1332 | CAGGGUCUCAAAAGGCUUCag |
| B3 | 563 | 1268 | UCUCCCUCAUCUACACCAAtt | 1333 | UUGGUGUAGAUGAGGGAGAtg |

TABLE 2 -continued

RNAi molecule sequences for GST-π

| ID | Ref Pos | SEQ ID NO SEQ ID NOS: 1216 to 1280 | SENSE STRAND (5'-->3') | SEQ ID NO SEQ ID NOS: 1281 to 1345 | ANTISENSE STRAND (5'-->3') |
|---|---|---|---|---|---|
| B4 | 567 | 1269 | CCUCAUCUACACCAACUAUtt | 1334 | AUAGUUGGUGUAGAUGAGGga |
| B5 | 566 | 1270 | CCCUCAUCUACACCAACUAtt | 1335 | UAGUUGGUGUAGAUGAGGGag |
| B6 | 625 | 1271 | CAACUGAAGCCUUUUGAGAtt | 1336 | UCUCAAAAGGCUUCAGUUGcc |
| B7 | 626 | 1272 | AACUGAAGCCUUUUGAGACtt | 1337 | GUCUCAAAAGGCUUCAGUUgc |
| B8 | 628 | 1273 | CUGAAGCCUUUUGAGACCCtt | 1338 | GGGUCUCAAAAGGCUUCAGtt |
| B9 | 565 | 1274 | UCCCUCAUCUACACCAACUtt | 1339 | AGUUGGUGUAGAUGAGGGAga |
| BG3 | 563 | 1275 | GCUCCCUCAUCUACACCAAtt | 1340 | UUGGUGUAGAUGAGGGAGCtg |
| BU2 | 630 | 1276 | GAAGCCUUUUGAGACCCUAtt | 1341 | UAGGGUCUCAAAAGGCUUCag |
| BU10 | 627 | 1277 | ACUGAAGCCUUUUGAGACAtt | 1342 | UGUCUCAAAAGGCUUCAGUtg |
| BU14 | 565 | 1278 | CUCCCUCAUCUACACCAAAtt | 1343 | UUUGGUGUAGAUGAGGGAGat |
| BU4 | 567 | 1279 | CCUCAUCUACACCAACUAAtt | 1344 | UUAGUUGGUGUAGAUGAGGga |
| C1-934 | 934 | 1280 | ACCAAUAAAAUUUCUAAGAtt | 1345 | UCUUAGAAAUUUUAUUGGUcc |

Key for Table 2: Upper case A, G, C and U refer to ribo-A, ribo-G, ribo-C and ribo-U, respectively. The lower case letters a, u, g, c, t refer to 2'-deoxy-A, 2'-deoxy-U, 2'-deoxy-G, 2'-deoxy-C, and deoxythymidine respectively.

Examples of RNAi molecules of this invention targeted to GST-π mRNA are shown in Table 3.

TABLE 3

RNAi molecule sequences for GST-π

| ID | SEQ ID NO SEQ ID NOS: 1346 to 1371 | SENSE STRAND (5'-->3') | SEQ ID NO SEQ ID NOS: 1372 to 1397 | ANTISENSE STRAND (5'-->3') |
|---|---|---|---|---|
| BU2' | 1346 | GAAGCCUUUUGAGACCCUANN | 1372 | UAGGGUCUCAAAAGGCUUCNN |
| 14 | 1347 | GAAGCCUUUUGAGACCCUAUU | 1373 | UAGGGUCUCAAAAGGCUUCUU |
| 15 | 1348 | GAAGCCUUUUGAGACCCUAUU | 1374 | uagggucuCAAAAGGCUUCUU |
| 16 | 1349 | GAAGCCUUUUGAGACCCUAUU | 1375 | UagggucuCAAAAGGCUUCUU |
| 17 | 1350 | GAAGCCUUUUGAGACCCUAUU | 1376 | UAgggucuCAAAAGGCUUCUU |
| 18 | 1351 | GAAGCCUUUUGAGACCCUAUU | 1377 | UAGgucuCAAAAGGCUUCUU |
| 19 | 1352 | GAAGCCUUUUGAGACCCUAUU | 1378 | UAGGgucuCAAAAGGCUUCUU |
| 20 | 1353 | GAAGCCUUUUGAGACCCUAUU | 1379 | uAgGgUcUCAAAAGGCUUCUU |
| 21 | 1354 | GAAGCCUUUUGAGACCCUAUU | 1380 | UAgGgUcUCAAAAGGCUUCUU |
| 22 | 1355 | GAAGCCUUUUGAGACCCUAUU | 1381 | UaGgGuCuCAAAAGGCUUCUU |
| 23 | 1356 | GAAGCCUUUUGAGACCCUAUU | 1382 | UAGgGuCuCAAAAGGCUUCUU |
| 24 | 1357 | GAAGCCUUUUGAGACCCUAtt | 1383 | UagggucuCAAAGGCUUCUU |
| 25 | 1358 | GAAGCCUUUUGAGACCCUAUU | 1384 | UAGGGUCUCAAAAGGCUUCUU |
| 26 | 1359 | GAAGCCUUUUGAGACCCUAUU | 1385 | fUAGGGUCUCAAAAGGCUUCUU |
| 27 | 1360 | GAAGCCUUUUGAGACCCUAUU | 1386 | uAGGGUCUCAAAAGGCUUCUU |
| 28 | 1361 | GAAGCCUUUUGAGACCCUAUU | 1387 | UsAGGGUCUCAAAAGGCUUCUU |

TABLE 3 -continued

RNAi molecule sequences for GST-π

| ID | SEQ ID NO SEQ ID NOS: 1346 to 1371 | SENSE STRAND (5'-->3') | SEQ ID NO SEQ ID NOS: 1372 to 1397 | ANTISENSE STRAND (5'-->3') |
|---|---|---|---|---|
| 29 | 1362 | GAAGCCUUUUGAGACCCUfAUU | 1388 | fUAGGGUCUfCAAAAGGCfUUCUU |
| 30 | 1363 | GAAGCCUUUUGAGfACCCUfAUU | 1389 | fUAGGGUCUfCAfAfAAGGCfUUCUU |
| 31 | 1364 | GAAGCCUUUUGAGACCCUAUU | 1390 | UAGGGUCUCAAAAGGCUUCUU |
| 31' | 1365 | GAAGCCUUUUGAGACCCUAUU | 1391 | fUAGGGUCUCAAAAGGCUUCUU |
| 32 | 1366 | GAAGCCUUUUGAGACCCUAUU | 1392 | UAGGGUCUCAAAAGGCUUCUU |
| 39 | 1367 | GAAGCCUUUUGAGACCCUAUU | 1393 | UAGgGuCuCAAAAGGCUUCUU |
| 45 | 1368 | GAAGCCUUUUGAGACCCUAUU | 1394 | UAGgGuCuCAAAAGGCUUCUU |
| 46 | 1369 | GAAGCCUUUUGAGACCCUAUU | 1395 | UAGgGuCuCAAAAGGCUUCUU |
| 47 | 1370 | GAAGCCUUUUGAGACCCUAUU | 1396 | UAGgGuCuCAAAAGGCUUCUU |
| 48 | 1371 | GAAGCCUUUUGAGACCCUAUU | 1397 | fUAGgGuCuCAAAAGGCUUCUU |

Key for Table 3: Upper case A, G, C and U refer to ribo-A, ribo-G, ribo-C and ribo-U, respectively. The lower case letters a, u, g, c, t refer to 2'-deoxy-A, 2'-deoxy-U, 2'-deoxy-G, 2'-deoxy-C, and deoxythymidine (dT=T=t) respectively. Underlining refers to 2'-OMe-substituted, e.g., U. The lower case letter f refers to 2'-deoxy-2'-fluoro substitution, e.g. fU is 2'-deoxy-2'-fluoro-U. N is A, C, G, U, U, a, c, g, u, t, or a modified, inverted, or chemically modified nucleotide. An "s" character represents a phosphorothioate linkage.

Examples of RNAi molecules of this invention targeted to GST-π mRNA are shown in Table 4.

TABLE 4

RNAi molecule sequences for GST-π

| ID | SEQ ID NO SEQ ID NOS: 1398 to 1409 | SENSE STRAND (5'-->3') | SEQ ID NO SEQ ID NOS: 1410 to 1421 | ANTISENSE STRAND (5'-->3') |
|---|---|---|---|---|
| A9' | 1398 | CCUUUUGAGACCCUGCUGUNN | 1410 | ACAGCAGGGUCUCAAAAGGNN |
| 1 | 1399 | CCUUUUGAGACCCUGCUGUUU | 1411 | ACAGCAGGGUCUCAAAAGGUU |
| 2 | 1400 | CCUUUUGAGACCCUGCUGUUU | 1412 | acagcaggGUCUCAAAAGGUU |
| 3 | 1401 | CCUUUUGAGACCCUGCUGUUU | 1413 | AcagcaggGUCUCAAAAGGUU |
| 4 | 1402 | CCUUUUGAGACCCUGCUGUUU | 1414 | ACagcaggGUCUCAAAAGGUU |
| 5 | 1403 | CCUUUUGAGACCCUGCUGUUU | 1415 | ACAgcaggGUCUCAAAAGGUU |
| 6 | 1404 | CCUUUUGAGACCCUGCUGUUU | 1416 | ACAGcaggGUCUCAAAAGGUU |
| 7 | 1405 | CCUUUUGAGACCCUGCUGUUU | 1417 | aCaCgAgGGUCUCAAAAGGUU |
| 8 | 1406 | CCUUUUGAGACCCUGCUGUUU | 1418 | ACaGcAgGGUCUCAAAAGGUU |
| 9 | 1407 | CCUUUUGAGACCCUGCUGUUU | 1419 | AcAgCaGgGUCUCAAAAGGUU |
| 10 | 1408 | CCUUUUGAGACCCUGCUGUUU | 1420 | ACAgCaGgGUCUCAAAAGGUU |
| 11 | 1409 | CCUUUUGAGACCCUGCUGUUU | 1421 | AcagcaggGUCUCAAAAGGUU |

Key for Table 4: Upper case A, G, C and U refer to ribo-A, ribo-G, ribo-C and ribo-U, respectively. The lower case letters a, u, g, c, t refer to 2'-deoxy-A, 2'-deoxy-U, 2'-deoxy-G, 2'-deoxy-C, and deoxythymidine (dT=T=t) respectively. Underlining refers to 2'-OMe-substituted, e.g., U. The lower case letter f refers to 2'-deoxy-2'-fluoro substitution, e.g. fU is 2'-deoxy-2'-fluoro-U. N is A, C, G, U, U, a, c, g, u, t, or a modified, inverted, or chemically modified nucleotide.

Examples of RNAi molecules of this invention targeted to GST-π mRNA are shown in Table 5.

TABLE 5

RNAi molecule sequences for GST-π

| ID | SEQ ID NO SEQ ID NOS: 1422 to 1436 | SENSE STRAND (5'-->3') | SEQ ID NO SEQ ID NOS: 1437 to 1451 | ANTISENSE STRAND (5'-->3') |
|---|---|---|---|---|
| B13' | 1422 | GGAUGACUAUGUGAAGGCANN | 1437 | UGCCUUCACAUAGUCAUCCNN |
| 4 | 1423 | GGAUGACUAUGUGAAGGCAUU | 1438 | UGCCUUCACAUAGUCAUCCUU |
| 5 | 1424 | GGAUGACUAUGUGAAGGCAUU | 1439 | ugccuucaCAUAGUCAUCCUU |

TABLE 5 -continued

RNAi molecule sequences for GST-π

| ID | SENSE STRAND SEQ ID NO (5'-->3') SEQ ID NOS: 1422 to 1436 | ANTISENSE STRAND SEQ ID NO (5'-->3') SEQ ID NOS: 1437 to 1451 |
|---|---|---|
| 6 | 1425 GGAUGACUAUGUGAAGGCA<u>UU</u> | 1440 Ugccuuca CAUAGUCAUCC<u>UU</u> |
| 7 | 1426 GGAUGACUAUGUGAAGGCA<u>UU</u> | 1441 UGccuuca CAUAGUCAUCC<u>UU</u> |
| 8 | 1427 GGAUGACUAUGUGAAGGCA<u>UU</u> | 1442 UGCcuuca CAUAGUCAUCC<u>UU</u> |
| 9 | 1428 GGAUGACUAUGUGAAGGCA<u>UU</u> | 1443 UGCCuuca CAUAGUCAUCC<u>UU</u> |
| 10 | 1429 GGAUGACUAUGUGAAGGCA<u>UU</u> | 1444 uGcCuUcACAUAGUCAUCC<u>UU</u> |
| 11 | 1430 GGAUGACUAUGUGAAGGCA<u>UU</u> | 1445 UGcCuUcACAUAGUCAUCC<u>UU</u> |
| 12 | 1431 GGAUGACUAUGUGAAGGCA<u>UU</u> | 1446 UgCcUuCaCAUAGUCAUCC<u>UU</u> |
| 13 | 1432 GGAUGACUAUGUGAAGGCA<u>UU</u> | 1447 UGCcUuCaCAUAGUCAUCC<u>UU</u> |
| 14 | 1433 <u>GGAUGA</u>CUAUGUGAAGGCA<u>UU</u> | 1448 Ugccuuca CAUAGU<u>CA</u>U<u>CC</u><u>UU</u> |
| 15 | 1434 GGAUGACUAU<i>fGUfG</i>AAGGCA<u>UU</u> | 1449 UGC<i>fC</i>UUCACAUAGUCAUCC<u>UU</u> |
| 17 | 1435 <u>GGAUGA</u>CUAUGUGAAGGCA<u>UU</u> | 1450 UGCCUUCA<u>CAUAGU</u>C<u>A</u>UCC<u>UU</u> |
| 18 | 1436 <u>GGAUGA</u>CUAUGUGAAGGCA<u>UU</u> | 1451 UGCCUUCACA<u>U</u>A<u>GU</u>CA<u>UCC</u><u>UU</u> |

Key for Table 5: Upper case A, G, C and U refer to ribo-A, ribo-G, ribo-C and ribo-U, respectively. The lower case letters a, u, g, c, t refer to 2'-deoxy-A, 2'-deoxy-U, 2'-deoxy-G, 2'-deoxy-C, and deoxythymidine (dT=T=t) respectively. Underlining refers to 2'-OMe-substituted, e.g., U. The lower case letter f refers to 2'-deoxy-2'-fluoro substitution, e.g. fU is 2'-deoxy-2'-fluoro-U. N is A, C, G, U, U, a, c, g, u, t, or a modified, inverted, or chemically modified nucleotide.

Examples of RNAi molecules of this invention targeted to GST-π mRNA are shown in Table 6.

TABLE 6

RNAi molecule sequences for GST-π

| ID | SENSE STRAND SEQ ID NO (5'-->3') SEQ ID NOS: 1452 to 1463 | ANTISENSE STRAND SEQ ID NO (5'-->3') SEQ ID NOS: 1464 to 1475 |
|---|---|---|
| B2' | 1452 GAAGCCUUUUGAGACCCUGNN | 1464 CAGGGUCUCAAAAGGCUUCNN |
| 1 | 1453 GAAGCCUUUUGAGACCCUG<u>UU</u> | 1465 CAGGGUCUCAAAAGGCUUC<u>UU</u> |
| 2 | 1454 GAAGCCUUUUGAGACCCUG<u>UU</u> | 1466 cagggucuCAAAAGGCUUC<u>UU</u> |
| 3 | 1455 GAAGCCUUUUGAGACCCUG<u>UU</u> | 1467 CagggucuCAAAAGGCUUC<u>UU</u> |
| 4 | 1456 GAAGCCUUUUGAGACCCUG<u>UU</u> | 1468 CAgggucuCAAAAGGCUUC<u>UU</u> |
| 5 | 1457 GAAGCCUUUUGAGACCCUG<u>UU</u> | 1469 CAGggucuCAAAAGGCUUC<u>UU</u> |
| 6 | 1458 GAAGCCUUUUGAGACCCUG<u>UU</u> | 1470 CAGGgucuCAAAAGGCUUC<u>UU</u> |
| 7 | 1459 GAAGCCUUUUGAGACCCUG<u>UU</u> | 1471 cAgGgUcUCAAAAGGCUUC<u>UU</u> |
| 8 | 1460 GAAGCCUUUUGAGACCCUG<u>UU</u> | 1472 CAgGgUcUCAAAAGGCUUC<u>UU</u> |
| 9 | 1461 GAAGCCUUUUGAGACCCUG<u>UU</u> | 1473 CaGgGuCuCAAAAGGCUUC<u>UU</u> |
| 10 | 1462 GAAGCCUUUUGAGACCCUG<u>UU</u> | 1474 CAgGgUcUCAAAAGGCUUC<u>UU</u> |
| 11 | 1463 <u>GAAGC</u>CUUUUGAGACCCUG<u>UU</u> | 1475 CagggucuCAAAA<u>GG</u>CUUC<u>UU</u> |

Key for Table 6: Upper case A, G, C and U refer to ribo-A, ribo-G, ribo-C and ribo-U, respectively. The lower case letters a, u, g, c, t refer to 2'-deoxy-A, 2'-deoxy-U, 2'-deoxy-G, 2'-deoxy-C, and deoxythymidine (dT=T=t) respectively. Underlining refers to 2'-OMe-substituted, e.g., U. The lower case letter f refers to 2'-deoxy-2'-fluoro substitution, e.g. fU is 2'-deoxy-2'-fluoro-U. N is A, C, G, U, U, a, c, g, u, t, or a modified, inverted, or chemically modified nucleotide.

Examples of RNAi molecules of this invention targeted to GST-π mRNA are shown in Table 7.

TABLE 7

RNAi molecule sequences for GST-π

| ID | SENSE STRAND SEQ ID NO (5'-->3') SEQ ID NOS: 1476 to 1487 | ANTISENSE STRAND SEQ ID NO (5'-->3') SEQ ID NOS: 1488 to 1499 |
|---|---|---|
| B4' | 1476 CCUCAUCUACACCAACUAUNN | 1488 AUAGUUGGUGUAGAUGAGGNN |
| 1 | 1477 CCUCAUCUACACCAACUA<u>UUU</u> | 1489 AUAGUUGGUGUAGAUGAGG<u>UU</u> |
| 2 | 1478 CCUCAUCUACACCAACUA<u>UUU</u> | 1490 auaguuggUGUAGAUGAGG<u>UU</u> |
| 3 | 1479 CCUCAUCUACACCAACUA<u>UUU</u> | 1491 AuaguuggUGUAGAUGAGG<u>UU</u> |
| 4 | 1480 CCUCAUCUACACCAACUA<u>UUU</u> | 1492 AUaguuggUGUAGAUGAGG<u>UU</u> |
| 5 | 1481 CCUCAUCUACACCAACUA<u>UUU</u> | 1493 AUAguuggUGUAGAUGAGG<u>UU</u> |
| 6 | 1482 CCUCAUCUACACCAACUA<u>UUU</u> | 1494 AUAGuuggUGUAGAUGAGG<u>UU</u> |
| 7 | 1483 CCUCAUCUACACCAACUA<u>UUU</u> | 1495 aUaGuUgGUGUAGAUGAGG<u>UU</u> |

TABLE 7 -continued

RNAi molecule sequences for GST-π

| SEQ ID NO | SENSE STRAND SEQ ID NOS: 1476 to 1487 (5'-->3') | SEQ ID NO | ANTISENSE STRAND SEQ ID NOS: 1488 to 1499 (5'-->3') |
|---|---|---|---|
| 8 | 1484 CCUCAUCUACACCAACUAUUU | 1496 | AUaGuUgGUGUAGAUGAGGUU |
| 9 | 1485 CCUCAUCUACACCAACUAUUU | 1497 | AuAgUuGgGUGUAGAUGAGGUU |
| 10 | 1486 CCUCAUCUACACCAACUAUUU | 1498 | AUAgUuGgGUGUAGAUGAGGUU |
| 11 | 1487 CCUCAUCUACACCAACUAUUU | 1499 | AuaguuggGUGUAGAUGAGGUU |

Key for Table 7: Upper case A, G, C and U refer to ribo-A, ribo-G, ribo-C and ribo-U, respectively. The lower case letters a, u, g, c, t refer to 2'-deoxy-A, 2'-deoxy-U, 2'-deoxy-G, 2'-deoxy-C, and deoxythymidine (dT=T=t) respectively. Underlining refers to 2'-OMe-substituted, e.g., U. The lower case letter f refers to 2'-deoxy-2'-fluoro substitution, e.g. fU is 2'-deoxy-2'-fluoro-U. N is A, C, G, U, U, a, c, g, u, t, or a modified, inverted, or chemically modified nucleotide.

In some embodiments, this invention provides a range of nucleic acid molecules, wherein: a) the molecule has a polynucleotide sense strand and a polynucleotide antisense strand; b) each strand of the molecule is from 15 to 30 nucleotides in length; c) a contiguous region of from 15 to 30 nucleotides of the antisense strand is complementary to a sequence of an mRNA encoding GST-π; d) at least a portion of the sense strand is complementary to at least a portion of the antisense strand, and the molecule has a duplex region of from 15 to 30 nucleotides in length.

In some embodiments, the nucleic acid molecule can have contiguous region of from 15 to 30 nucleotides of the antisense strand that is complementary to a sequence of an mRNA encoding GST-π is located in the duplex region of the molecule.

In additional embodiments, the nucleic acid molecule can have a contiguous region of from 15 to 30 nucleotides of the antisense strand that is complementary to a sequence of an mRNA encoding GST-π.

In certain embodiments, each strand of the nucleic acid molecule can be from 18 to 22 nucleotides in length. The duplex region of the nucleic acid molecule can be 19 nucleotides in length.

In alternative forms, the nucleic acid molecule can have a polynucleotide sense strand and a polynucleotide antisense strand that are connected as a single strand, and form a duplex region connected at one end by a loop.

Some embodiments of a nucleic acid molecule of this disclosure can have a blunt end. In certain embodiments, a nucleic acid molecule can have one or more 3' overhangs.

This invention provides a range of nucleic acid molecules that are RNAi molecules active for gene silencing. The inventive nucleic acid molecules can be a dsRNA, a siRNA, a micro-RNA, or a shRNA active for gene silencing, as well as a DNA-directed RNA (ddRNA), Piwi-interacting RNA (piRNA), or a repeat associated siRNA (rasiRNA). The nucleic acid molecules can be active for inhibiting expression of GST-π.

Embodiments of this invention further provide nucleic acid molecules having an IC50 for knockdown of GST-π of less than 100 pM.

Additional embodiments of this invention provide nucleic acid molecules having an IC50 for knockdown of GST-π of less than 50 pM.

This invention further contemplates compositions containing one or more of the inventive nucleic acid molecules, along with a pharmaceutically acceptable carrier. In certain embodiments, the carrier can be a lipid molecule or liposome.

The compounds and compositions of this invention are useful in methods for preventing or treating a GST-π associated disease, by administering a compound or composition to a subject in need.

The methods of this invention can utilize the inventive compounds for preventing or treating malignant tumor. The malignant tumor can be presented in various diseases, for example, cancers associated with GST-π expression, cancers caused by cells expressing mutated KRAS, sarcomas, fibrosarcoma, malignant fibrous histiocytoma, liposarcoma, rhabdomyosarcoma, leiomyosarcoma, angiosarcoma, Kaposi's sarcoma, lymphangiosarcoma, synovial sarcoma, chondrosarcoma, osteosarcoma, carcinomas, brain tumor, head and neck cancer, breast cancer, lung cancer, esophageal cancer, stomach cancer, duodenal cancer, appendix cancer, colorectal cancer, rectal cancer, liver cancer, pancreatic cancer, gallbladder cancer, bile duct cancer, anus cancer, kidney cancer, urethral cancer, urinary bladder cancer, prostate cancer, testicular cancer, uterine cancer, ovary cancer, skin cancer, leukemia, malignant lymphoma, epithelial malignant tumors, and non-epithelial malignant tumors.

Modified and Chemically-Modified siRNAs

Embodiments of this invention encompass siRNA molecules that are modified or chemically-modified to provide enhanced properties for therapeutic use, such as increased activity and potency for gene silencing. This invention provides modified or chemically-modified siRNA molecules that can have increased serum stability, as well as reduced off target effects, without loss of activity and potency of the siRNA molecules for gene modulation and gene silencing. In some aspects, this invention provides siRNAs having modifications or chemical modifications in various combinations, which enhance the stability and efficacy of the siRNA.

In some embodiments, the siRNA molecules of this invention can have passenger strand off target activity reduced by at least 10-fold, or at least 20-fold, or at least 30-fold, or at least 50-fold, or at least 100-fold.

As used herein, the terms modified and chemically-modified refer to changes made in the structure of a naturally-occurring nucleotide or nuclei acid structure of an siRNA, which encompasses siRNAs having one or more nucleotide analogs, altered nucleotides, non-standard nucleotides, non-naturally occurring nucleotides, and combinations thereof.

In some embodiments, the number of modified or chemically-modified structures in an siRNA can include all of the structural components, and/or all of the nucleotides of the siRNA molecule.

Examples of modified and chemically-modified siRNAs include siRNAs having modification of the sugar group of a nucleotide, modification of a nucleobase of a nucleotide, modification of a nucleic acid backbone or linkage, modification of the structure of a nucleotide or nucleotides at the terminus of a siRNA strand, and combinations thereof.

Examples of modified and chemically-modified siRNAs include siRNAs having modification of the substituent at the 2' carbon of the sugar.

Examples of modified and chemically-modified siRNAs include siRNAs having modification at the 5' end, the 3' end, or at both ends of a strand.

Examples of modified and chemically-modified siRNAs include siRNAs having modifications that produce complementarity mismatches between the strands.

Examples of modified and chemically-modified siRNAs include siRNAs having a 5'-propylamine end, a 5'-phosphorylated end, a 3'-puromycin end, or a 3'-biotin end group.

Examples of modified and chemically-modified siRNAs include siRNAs having a 2'-fluoro substituted ribonucleotide, a 2'-OMe substituted ribonucleotide, a 2'-deoxy ribonucleotide, a 2'-amino substituted ribonucleotide, a 2'-thio substituted ribonucleotide.

Examples of modified and chemically-modified siRNAs include siRNAs having one or more 5-halouridines, 5-halocytidines, 5-methylcytidines, ribothymidines, 2-aminopurines, 2,6-diaminopurines, 4-thiouridines, or 5-aminoallyluridines.

Examples of modified and chemically-modified siRNAs include siRNAs having one or more phosphorothioate groups.

Examples of modified and chemically-modified siRNAs include siRNAs having one or more 2'-fluoro substituted ribonucleotides, 2'-fluorouridines, 2'-fluorocytidines, 2'-deoxyribonucleotides, 2'-deoxyadenosines, or 2'-deoxyguanosines.

Examples of modified and chemically-modified siRNAs include siRNAs having one or more phosphorothioate linkages.

Examples of modified and chemically-modified siRNAs include siRNAs having one or more alkylene diol linkages, oxy-alkylthio linkages, or oxycarbonyloxy linkages.

Examples of modified and chemically-modified siRNAs include siRNAs having one or more deoxyabasic groups, inosines, N3-methyl-uridines, N6,N6-dimethyl-adenosines, pseudouridines, purine ribonucleosides, and ribavirins.

Examples of modified and chemically-modified siRNAs include siRNAs having one or more 3' or 5' inverted terminal groups.

Examples of modified and chemically-modified siRNAs include siRNAs having one or more 5-(2-amino)propyluridines, 5-bromouridines, adenosines, 8-bromo guanosines, 7-deaza-adenosines, or N6-methyl adenosine.

Methods for Modulating GST-π and Treating Malignant Tumor

Embodiments of this invention can provide RNAi molecules that can be used to down regulate or inhibit the expression of GST-π and/or GST-π proteins.

In some embodiments, a RNAi molecule of this invention can be used to down regulate or inhibit the expression of GST-π and/or GST-π proteins arising from GST-π haplotype polymorphisms that may be associated with a disease or condition such as malignant tumor.

Monitoring of GST-π protein or mRNA levels can be used to characterize gene silencing, and to determine the efficacy of compounds and compositions of this invention.

The RNAi molecules of this disclosure can be used individually, or in combination with other siRNAs for modulating the expression of one or more genes.

The RNAi molecules of this disclosure can be used individually, or in combination, or in conjunction with other known drugs for preventing or treating diseases, or ameliorating symptoms of conditions or disorders associated with GST-π, including malignant tumor.

The RNAi molecules of this invention can be used to modulate or inhibit the expression of GST-π in a sequence-specific manner.

The RNAi molecules of this disclosure can include a guide strand for which a series of contiguous nucleotides are at least partially complementary to a GST-π mRNA.

In certain aspects, malignant tumor may be treated by RNA interference using a RNAi molecule of this invention.

Treatment of malignant tumor may be characterized in suitable cell-based models, as well as ex vivo or in vivo animal models.

Treatment of malignant tumor may be characterized by determining the level of GST-π mRNA or the level of GST-π protein in cells of affected tissue.

Treatment of malignant tumor may be characterized by non-invasive medical scanning of an affected organ or tissue.

Embodiments of this invention may include methods for preventing, treating, or ameliorating the symptoms of a GST-π associated disease or condition in a subject in need thereof.

In some embodiments, methods for preventing, treating, or ameliorating the symptoms of malignant tumor in a subject can include administering to the subject a RNAi molecule of this invention to modulate the expression of a GST-π gene in the subject or organism.

In some embodiments, this invention contemplates methods for down regulating the expression of a GST-π gene in a cell or organism, by contacting the cell or organism with a RNAi molecule of this invention.

Embodiments of this invention encompass siRNA molecules of Tables 2-7 that are modified or chemically-modified according to the examples above.

RNA Interference

RNA interference (RNAi) refers to sequence-specific post-transcriptional gene silencing in animals mediated by short interfering RNAs (siRNAs). See, e.g., Zamore et al., Cell, 2000, Vol. 101, pp. 25-33; Fire et al., Nature, 1998, Vol. 391, pp. 806811; Sharp, Genes & Development, 1999, Vol. 13, pp. 139-141.

An RNAi response in cells can be triggered by a double stranded RNA (dsRNA), although the mechanism is not yet fully understood. Certain dsRNAs in cells can undergo the action of Dicer enzyme, a ribonuclease III enzyme. See, e.g., Zamore et al., Cell, 2000, Vol. 101, pp. 25-33; Hammond et al., Nature, 2000, Vol. 404, pp. 293-296. Dicer can process the dsRNA into shorter pieces of dsRNA, which are siRNAs.

In general, siRNAs can be from about 21 to about 23 nucleotides in length and include a base pair duplex region about 19 nucleotides in length.

RNAi involves an endonuclease complex known as the RNA induced silencing complex (RISC). An siRNA has an antisense or guide strand which enters the RISC complex and mediates cleavage of a single stranded RNA target having a sequence complementary to the antisense strand of the siRNA duplex. The other strand of the siRNA is the passenger strand. Cleavage of the target RNA takes place in the middle of the region complementary to the antisense strand of the siRNA duplex See, e.g., Elbashir et al., Genes & Development, 2001, Vol. 15, pp. 188-200.

As used herein, the term "sense strand" refers to a nucleotide sequence of a siRNA molecule that is partially or fully complementary to at least a portion of a corresponding antisense strand of the siRNA molecule. The sense strand of a siRNA molecule can include a nucleic acid sequence having homology with a target nucleic acid sequence.

As used herein, the term "antisense strand" refers to a nucleotide sequence of a siRNA molecule that is partially or fully complementary to at least a portion of a target nucleic acid sequence. The antisense strand of a siRNA molecule can include a nucleic acid sequence that is complementary to at least a portion of a corresponding sense strand of the siRNA molecule.

RNAi molecules can down regulate or knock down gene expression by mediating RNA interference in a sequence-specific manner. See, e.g., Zamore et al., Cell, 2000, Vol. 101, pp. 25-33; Elbashir et al., Nature, 2001, Vol. 411, pp. 494-498; Kreutzer et al., WO2000/044895; Zernicka-Goetz et al., WO2001/36646; Fire et al., WO1999/032619; Plaetinck et al., WO2000/01846; Mello et al., WO2001/029058.

As used herein, the terms "inhibit," "down-regulate," or "reduce" with respect to gene expression means that the expression of the gene, or the level of mRNA molecules encoding one or more proteins, or the activity of one or more of the encoded proteins is reduced below that observed in the absence of a RNAi molecule or siRNA of this invention. For example, the level of expression, level of mRNA, or level of encoded protein activity may be reduced by at least 1%, or at least 10%, or at least 20%, or at least 50%, or at least 90%, or more from that observed in the absence of a RNAi molecule or siRNA of this invention.

RNAi molecules can also be used to knock down viral gene expression, and therefore affect viral replication.

RNAi molecules can be made from separate polynucleotide strands: a sense strand or passenger strand, and an antisense strand or guide strand. The guide and passenger strands are at least partially complementary. The guide strand and passenger strand can form a duplex region having from about 15 to about 49 base pairs.

In some embodiments, the duplex region of a siRNA can have 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 base pairs.

In certain embodiments, a RNAi molecule can be active in a RISC complex, with a length of duplex region active for RISC.

In additional embodiments, a RNAi molecule can be active as a Dicer substrate, to be converted to a RNAi molecule that can be active in a RISC complex.

In some aspects, a RNAi molecule can have complementary guide and passenger sequence portions at opposing ends of a long molecule, so that the molecule can form a duplex region with the complementary sequence portions, and the strands are linked at one end of the duplex region by either nucleotide or non-nucleotide linkers. For example, a hairpin arrangement, or a stem and loop arrangement. The linker interactions with the strands can be covalent bonds or non-covalent interactions.

A RNAi molecule of this disclosure may include a nucleotide, non-nucleotide, or mixed nucleotide/non-nucleotide linker that joins the sense region of the nucleic acid to the antisense region of the nucleic acid. A nucleotide linker can be a linker of ≥2 nucleotides in length, for example about 3, 4, 5, 6, 7, 8, 9, or 10 nucleotides in length. The nucleotide linker can be a nucleic acid aptamer. By "aptamer" or "nucleic acid aptamer" as used herein refers to a nucleic acid molecule that binds specifically to a target molecule wherein the nucleic acid molecule has sequence that includes a sequence recognized by the target molecule in its natural setting. Alternately, an aptamer can be a nucleic acid molecule that binds to a target molecule, where the target molecule does not naturally bind to a nucleic acid. For example, the aptamer can be used to bind to a ligand-binding domain of a protein, thereby preventing interaction of the naturally occurring ligand with the protein. See, e.g., Gold et al., Annu Rev Biochem, 1995, Vol. 64, pp. 763-797; Brody et al., J. Biotechnol., 2000, Vol. 74, pp. 5-13; Hermann et al., Science, 2000, Vol. 287, pp. 820-825.

Examples of a non-nucleotide linker include an abasic nucleotide, polyether, polyamine, polyamide, peptide, carbohydrate, lipid, polyhydrocarbon, or other polymeric compounds, for example polyethylene glycols such as those having from 2 to 100 ethylene glycol units. Some examples are described in Seela et al., Nucleic Acids Research, 1987, Vol. 15, pp. 3113-3129; Cload et al., J. Am. Chem. Soc., 1991, Vol. 113, pp. 6324-6326; Jaeschke et al., Tetrahedron Lett., 1993, Vol. 34, pp. 301; Arnold et al., WO1989/002439; Usman et al., WO1995/006731; Dudycz et al., WO1995/011910, and Ferentz et al., J. Am. Chem. Soc., 1991, Vol. 113, pp. 4000-4002.

A RNAi molecule can have one or more overhangs from the duplex region. The overhangs, which are non-base-paired, single strand regions, can be from one to eight nucleotides in length, or longer. An overhang can be a 3'-end overhang, wherein the 3'-end of a strand has a single strand region of from one to eight nucleotides. An overhang can be a 5'-end overhang, wherein the 5'-end of a strand has a single strand region of from one to eight nucleotides.

The overhangs of a RNAi molecule can have the same length, or can be different lengths.

A RNAi molecule can have one or more blunt ends, in which the duplex region ends with no overhang, and the strands are base paired to the end of the duplex region.

A RNAi molecule of this disclosure can have one or more blunt ends, or can have one or more overhangs, or can have a combination of a blunt end and an overhang end.

A 5'-end of a strand of a RNAi molecule may be in a blunt end, or can be in an overhang. A 3'-end of a strand of a RNAi molecule may be in a blunt end, or can be in an overhang.

A 5'-end of a strand of a RNAi molecule may be in a blunt end, while the 3'-end is in an overhang. A 3'-end of a strand of a RNAi molecule may be in a blunt end, while the 5'-end is in an overhang.

In some embodiments, both ends of a RNAi molecule are blunt ends.

In additional embodiments, both ends of a RNAi molecule have an overhang.

The overhangs at the 5'- and 3'-ends may be of different lengths.

In certain embodiments, a RNAi molecule may have a blunt end where the 5'-end of the antisense strand and the 3'-end of the sense strand do not have any overhanging nucleotides.

In further embodiments, a RNAi molecule may have a blunt end where the 3'-end of the antisense strand and the 5'-end of the sense strand do not have any overhanging nucleotides.

A RNAi molecule may have mismatches in base pairing in the duplex region.

Any nucleotide in an overhang of a RNAi molecule can be a deoxyribonucleotide, or a ribonucleotide.

One or more deoxyribonucleotides may be at the 5'-end, where the 3'-end of the other strand of the RNAi molecule may not have an overhang, or may not have a deoxyribonucleotide overhang.

One or more deoxyribonucleotides may be at the 3'-end, where the 5'-end of the other strand of the RNAi molecule may not have an overhang, or may not have a deoxyribonucleotide overhang.

In some embodiments, one or more, or all of the overhang nucleotides of a RNAi molecule may be 2'-deoxyribonucleotides.

Dicer Substrate RNAi Molecules

In some aspects, a RNAi molecule can be of a length suitable as a Dicer substrate, which can be processed to produce a RISC active RNAi molecule. See, e.g., Rossi et al., US2005/0244858.

A double stranded RNA (dsRNA) that is a Dicer substrate can be of a length sufficient such that it is processed by Dicer to produce an active RNAi molecule, and may further include one or more of the following properties: (i) the Dicer substrate dsRNA can be asymmetric, for example, having a 3' overhang on the antisense strand, and (ii) the Dicer substrate dsRNA can have a modified 3' end on the sense strand to direct orientation of Dicer binding and processing of the dsRNA to an active RNAi molecule.

In certain embodiments, the longest strand in a Dicer substrate dsRNA may be 24-30 nucleotides in length.

A Dicer substrate dsRNA can be symmetric or asymmetric.

In some embodiments, a Dicer substrate dsRNA can have a sense strand of 22-28 nucleotides and an antisense strand of 24-30 nucleotides.

In certain embodiments, a Dicer substrate dsRNA may have an overhang on the 3' end of the antisense strand.

In further embodiments, a Dicer substrate dsRNA may have a sense strand 25 nucleotides in length, and an antisense strand 27 nucleotides in length, with a 2 base 3'-overhang. The overhang may be 1, 2 or 3 nucleotides in length. The sense strand may also have a 5' phosphate.

An asymmetric Dicer substrate dsRNA may have two deoxyribonucleotides at the 3'-end of the sense strand in place of two of the ribonucleotides.

The sense strand of a Dicer substrate dsRNA may be from about 22 to about 30, or from about 22 to about 28; or from about 24 to about 30; or from about 25 to about 30; or from about 26 to about 30; or from about 26 and 29; or from about 27 to about 28 nucleotides in length.

The sense strand of a Dicer substrate dsRNA may be 22, 23, 24, 25, 26, 27, 28, 29 or 30 nucleotides in length.

In certain embodiments, a Dicer substrate dsRNA may have sense and antisense strands that are at least about 25 nucleotides in length, and no longer than about 30 nucleotides in length.

In certain embodiments, a Dicer substrate dsRNA may have sense and antisense strands that are 26 to 29 nucleotides in length.

In certain embodiments, a Dicer substrate dsRNA may have sense and antisense strands that are 27 nucleotides in length.

The sense and antisense strands of a Dicer substrate dsRNA may be the same length as in being blunt ended, or different lengths as in having overhangs, or may have a blunt end and an overhang.

A Dicer substrate dsRNA may have a duplex region of 19, 20, 21, 22, 23, 24, 25, 26 or 27 nucleotides in length.

The antisense strand of a Dicer substrate dsRNA may have any sequence that anneals to at least a portion of the sequence of the sense strand under biological conditions, such as within the cytoplasm of a eukaryotic cell.

A Dicer substrate with a sense and an antisense strand can be linked by a third structure, such as a linker group or a linker oligonucleotide. The linker connects the two strands of the dsRNA, for example, so that a hairpin is formed upon annealing.

The sense and antisense strands of a Dicer substrate are in general complementary, but may have mismatches in base pairing.

In some embodiments, a Dicer substrate dsRNA can be asymmetric such that the sense strand has 22-28 nucleotides and the antisense strand has 24-30 nucleotides.

A region of one of the strands, particularly the antisense strand, of the Dicer substrate dsRNA may have a sequence length of at least 19 nucleotides, wherein these nucleotides are in the 21-nucleotide region adjacent to the 3' end of the antisense strand and are sufficiently complementary to a nucleotide sequence of the RNA produced from the target gene.

An antisense strand of a Dicer substrate dsRNA can have from 1 to 9 ribonucleotides on the 5'-end, to give a length of 22-28 nucleotides. When the antisense strand has a length of 21 nucleotides, then 1-7 ribonucleotides, or 2-5 ribonucleotides, or 4 ribonucleotides may be added on the 3'-end. The added ribonucleotides may have any sequence.

A sense strand of a Dicer substrate dsRNA may have 24-30 nucleotides. The sense strand may be substantially complementary with the antisense strand to anneal to the antisense strand under biological conditions.

Methods for Using RNAi Molecules

The nucleic acid molecules and RNAi molecules of this invention may be delivered to a cell or tissue by direct application of the molecules, or with the molecules combined with a carrier or a diluent.

The nucleic acid molecules and RNAi molecules of this invention can be delivered or administered to a cell, tissue, organ, or subject by direct application of the molecules with a carrier or diluent, or any other delivery vehicle that acts to assist, promote or facilitate entry into a cell, for example, viral sequences, viral material, or lipid or liposome formulations.

The nucleic acid molecules and RNAi molecules of this invention can be complexed with cationic lipids, packaged within liposomes, or otherwise delivered to target cells or tissues. The nucleic acid or nucleic acid complexes can be locally administered to relevant tissues ex vivo, or in vivo through direct dermal application, transdermal application, or injection.

Delivery systems may include, for example, aqueous and nonaqueous gels, creams, emulsions, microemulsions, liposomes, ointments, aqueous and nonaqueous solutions, lotions, aerosols, hydrocarbon bases and powders, and can contain excipients such as solubilizers and permeation enhancers.

Compositions and methods of this disclosure can include an expression vector that includes a nucleic acid sequence encoding at least one RNAi molecule of this invention in a manner that allows expression of the nucleic acid molecule.

The nucleic acid molecules and RNAi molecules of this invention can be expressed from transcription units inserted into DNA or RNA vectors. Recombinant vectors can be DNA plasmids or viral vectors. Viral vectors can be used that provide for transient expression of nucleic acid molecules.

For example, the vector may contain sequences encoding both strands of a RNAi molecule of a duplex, or a single nucleic acid molecule that is self-complementary and thus forms a RNAi molecule. An expression vector may include a nucleic acid sequence encoding two or more nucleic acid molecules.

A nucleic acid molecule may be expressed within cells from eukaryotic promoters. Those skilled in the art realize that any nucleic acid can be expressed in eukaryotic cells from the appropriate DNA/RNA vector.

In some aspects, a viral construct can be used to introduce an expression construct into a cell, for transcription of a dsRNA construct encoded by the expression construct.

Lipid formulations can be administered to animals by intravenous, intramuscular, or intraperitoneal injection, or orally or by inhalation or other methods as are known in the art.

Pharmaceutically acceptable formulations for administering oligonucleotides are known and can be used.

Example Protocol for In Vitro Knockdown

One day before the transfection, cells were plated in a 96-well plate at 2×103 cells per well with 100 µl of DMEM (HyClone Cat. #SH30243.01) containing 10% FBS and culture in a 37° C. incubator containing a humidified atmosphere of 5% CO2 in air. Before transfection, medium was changed to 90 µl of Opti-MEM I Reduced Serum Medium (Life Technologies Cat. #31985-070) containing 2% FBS. Then, 0.2 µl of Lipofectamine RNAiMax (Life Technologies Cat. #13778-100) was mixed with 4.8 µl of Opti-MEM I for 5 minutes at room temperature. Next, 1 µl of siRNA was mixed with 4 µl of Opti-MEM I and combined with the LF2000 solution, and mixed gently, without vortex. After 5 minutes at room temperature, the mixture was incubated for an additional 10 minutes at room temperature to allow the RNA-RNAiMax complexes to form. Further, the 10 µl of RNA-RNAiMax complexes was added to a well, and the plate was shaken gently by hand. The cells were incubated in a 37° C. incubator containing a humidified atmosphere of 5% CO2 in air for 2 hours. The medium was changed to fresh Opti-MEM I Reduced Serum Medium containing 2% FBS. 24 hours after transfection, the cells were washed with ice-cold PBS once. The cells were lysed with 50 µl of Cell-to-Ct Lysis Buffer (Life Technologies Cat. #4391851 C) for 5-30 minutes at room temperature. 5 µl of Stop Solution was added, and it was incubated for 2 minutes at room temperature. The mRNA level was measured by RT-qPCR with TAQMAN immediately. Samples could be frozen at −80° C. and assayed at a later time.

Example Protocol for Serum Stability 0.2 mg/ml siRNA was incubated with 10% human serum at 37° C. At certain time points (0, 5, 15 and 30 min), 200 µl of sample was aliquoted and extracted with 200 µl extraction solvent (Chloroform:phenol:Isoamyl alcohol=24:25:1). The sample was vortexed and centrifuged at 13,000 rpm for 10 min at RT, then the top layer solution was transferred and filtered it with 0.45 µm filter. The filtrate was transferred into a 300 µl HPLC injection vial. For LCMS, the Mobile phase was MPA: 100 mM HFIP+7 mM TEA in H2O, MPB: 50% Methanol+50% Acetonitrile. The Column: Waters Acquity OST 2.1×50 mm, 1.7 µm.

EXAMPLES

Example 1 siRNAs of this invention targeted to GST-π were found to be active for gene silencing in vitro. The dose-dependent activities of GST-π siRNAs for gene knockdown were found to exhibit an IC50 below about 250 picomolar (pM), and as low as 1 pM.

In vitro transfection was performed in an A549 cell line to determine siRNA knockdown efficacy. Dose dependent knockdown for GST-π mRNA was observed with siRNAs of Table 2, as shown in Table 8.

TABLE 8

Dose dependent knockdown for GST-π mRNA in an A549 cell line

| siRNA structure | IC50 (pM) |
| --- | --- |
| A9 (SEQ ID NOs: 1240 and 1305) | 24 |
| B2 (SEQ ID NOs: 1267 and 1332) | 121 |
| B3 (SEQ ID NOs: 1268 and 1333) | 235 |
| B4 (SEQ ID NOs: 1269 and 1334) | 229 |
| B13 (SEQ ID NOs: 1265 and 1330) | 17 |
| BU2 (SEQ ID NOs: 1276 and 1341) | 31 |

As shown in Table 8, the activities of GST-π siRNAs of Table 2 were in the range 17-235 pM, which is suitable for many uses, including as a drug agent to be used in vivo.

Example 2

FIG. 2 shows inhibition of cell proliferation by GST-π targeted siRNA. Dose-dependent inhibition of proliferation was observed in an A549 cell line in vitro with siRNA targeted to GST-π, as shown in FIG. 2.

Example 3

Figure 3:
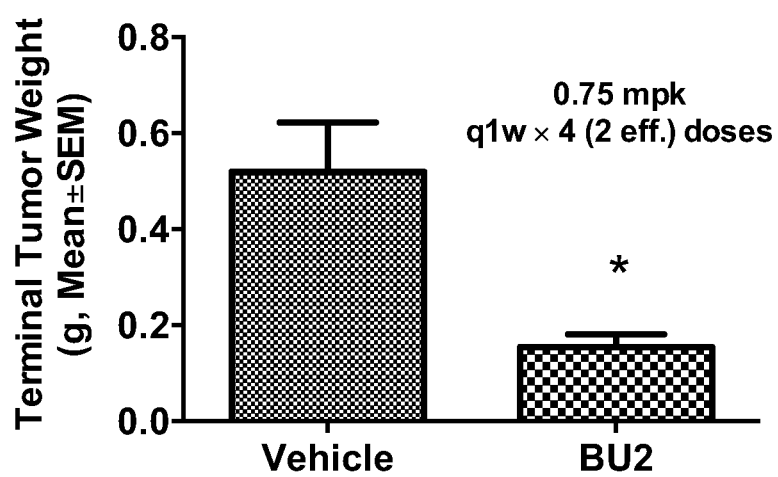
FIG. 3 shows tumor inhibition efficacy for GST-π siRNA. A pancreatic cancer xenograft model was utilized with a relatively low dose at 0.75 mg/kg of siRNA targeted to GST-π. The GST-π siRNA demonstrated significant tumor inhibition efficacy.

FIG. 3 shows tumor inhibition efficacy for GST-π siRNA (BU02). A pancreatic cancer xenograft model was utilized with a relatively low dose at 0.75 mg/kg of siRNA targeted to GST-π. The GST-π siRNA demonstrated significant and unexpectedly advantageous tumor inhibition efficacy at day 28.

In this experiment, A549 and PANC-1 cell lines were obtained from ATCC. The cell suspension was mixed well with ice thawed BD matrigel at 1:1 ratio for injection. Each mouse, athymic nude female mice, 6 to 8 weeks, Charles River, was inoculated subcutaneously in the right flank with 0.1 ml of an inoculum of $2 \times 10^6$ (A549) or $2.5 \times 10^6$ (PANC-1) cells using a 25 G needle and syringe (1 inoculum per mouse). Mice were anesthetized for inoculation. On the day when the established tumors reached approximately 250-350 mm³ (A549) or 150-250 mm³ (PANC-1) animals were subjected to bolus injection through tail vein. Animals were sacrificed by overdosed $CO_2$ and tumors dissected at different time points following the dosing. Tumors were first wet weighted, and then separated into three parts for measurement of GST-π knockdown, biodistribution of siRNA, and biomarker analysis. The samples were snap frozen in liquid nitrogen and stored at −80° C. until ready to be processed for bioanalysis.

Example 4

The structure of GST-π siRNAs of this invention having deoxynucleotides located in the seed region of the antisense strand of the siRNA provided unexpectedly and advantageously increased gene knockdown activity in vitro.

In vitro transfection was performed in an A549 cell line to determine knockdown efficacy for GST-π siRNAs based on structure BU2' (SEQ ID NOs:1346 and 1372). Dose dependent knockdown of GST-π mRNA was observed with GST-π siRNAs based on structure BU2' as shown in Table 9.

TABLE 9

Dose dependent knockdown of GST-π mRNA in an A549 cell line for GST-π siRNAs based on structure BU2'

| GST-π siRNA structure | IC50 (pM) |
|---|---|
| BU2 with no deoxynucleotides in the duplex region (SEQ ID NOs: 1276 and 1341) | 31 |
| BU2 with deoxynucleotides in positions 3, 5, and 7 of the seed region antisense strand (SEQ ID NOs: 1354 and 1380) | 5 |
| BU2 with deoxynucleotides in positions 4, 6, and 8 of the seed region antisense strand (SEQ ID NOs: 1356 and 1382) | 8 |
| BU2 with deoxynucleotides in positions 4, 6, and 8 of the seed region antisense strand (SEQ ID NOs: 1371 and 1397) | 5 |

As shown in Table 9, the activities of GST-π siRNAs based on structure BU2' having three deoxynucleotides in the seed region of the antisense strand were surprisingly and unexpectedly increased by up to 6-fold, as compared to a GST-π siRNA without deoxynucleotides in the duplex region.

These data show that GST-π siRNAs having a structure with three deoxynucleotides located at positions 3, 5 and 7, or at positions 4, 6 and 8 in the seed region of the antisense strand provided surprisingly increased gene knockdown activity as compared to a GST-π siRNA without deoxynucleotides in the duplex region.

The activities shown in Table 9 for GST-π siRNAs having three deoxynucleotides in the seed region of the antisense strand were in the range 5 to 8 pM, which is exceptionally suitable for many uses, including as a drug agent to be used in vivo.

Example 5

The structure of GST-π siRNAs of this invention having deoxynucleotides located in the seed region of the antisense strand of the siRNA provided unexpectedly and advantageously increased gene knockdown activity in vitro.

In vitro transfection was performed in an A549 cell line to determine knockdown efficacy for GST-π siRNAs based on structure A9' (SEQ ID NOs:1398 and 1410). Dose dependent knockdown of GST-π mRNA was observed with the GST-π siRNAs based on structure A9', as shown in Table 10.

TABLE 10

Dose dependent knockdown of GST-π mRNA in an A549 cell line for GST-π siRNAs based on structure structure A9'

| GST-π siRNA structure | IC50 (pM) |
|---|---|
| A9 with no deoxynucleotides in the duplex region (SEQ ID NOs: 1240 and 1305) | 24 |
| A9 with deoxynucleotides in positions 4, 6, and 8 of the seed region antisense strand (SEQ ID NOs: 1408 and 1420) | 1 |
| A9 with deoxynucleotides in positions 1, 3, 5, and 7 of the seed region antisense strand (SEQ ID NOs: 1405 and 1417) | 5 |
| A9 with deoxynucleotides in positions 3-8 of the seed region antisense strand (SEQ ID NOs: 1402 and 1414) | 6 |
| A9 with deoxynucleotides in positions 5-8 of the seed region antisense strand (SEQ ID NOs: 1404 and 1416) | 7 |
| A9 with deoxynucleotides in positions 3, 5, and 7 of the seed region antisense strand (SEQ ID NOs: 1406 and 1418) | 15 |

As shown in Table 10, the activities of GST-π siRNAs based on structure A9' having three to six deoxynucleotides in the seed region of the antisense strand were surprisingly increased by up to 24-fold, as compared to a GST-π siRNA without deoxynucleotides in the duplex region.

These data show that GST-π siRNAs having a structure with three to six deoxynucleotides located at positions 4, 6 and 8, or at positions 1, 3, 5 and 7, or at positions 3-8, or at positions 5-8, or at positions 3, 5 and 7 in the seed region of the antisense strand provided unexpectedly increased gene knockdown activity as compared to a GST-π siRNA without deoxynucleotides in the duplex region.

The activity shown in Table 10 for GST-π siRNAs having three to six deoxynucleotides in the seed region of the antisense strand was in the range 1 to 15 pM, which is exceptionally suitable for many uses, including as a drug agent to be used in vivo.

Example 6

The structure of GST-π siRNAs having deoxynucleotides located in the seed region of the antisense strand of the siRNA provided unexpectedly and advantageously increased gene knockdown activity in vitro.

In vitro transfection was performed in an A549 cell line to determine knockdown efficacy for GST-π siRNAs based on structure B13' (SEQ ID NOs:1422 and 1437). Dose dependent knockdown of GST-π mRNA was observed with the GST-π siRNAs based on structure B13', as shown in Table 11.

TABLE 11

Dose dependent knockdown of GST-π mRNA in an A549 cell line for GST-π siRNAs based on structure B13'

| GST-π siRNA structure | IC50 (pM) |
|---|---|
| B13 with no deoxynucleotides in the duplex region (SEQ ID NOs: 1265 and 1330) | 17 |
| B13 with deoxynucleotides in positions 4, 6, and 8 of the seed region antisense strand (SEQ ID NOs: 1432 and 1447) | 11 |

As shown in Table 11, the activity of a GST-π siRNA based on structure B13' having three deoxynucleotides in the seed region of the antisense strand was unexpectedly increased, as compared to a GST-π siRNA without deoxynucleotides in the duplex region.

These data show that GST-π siRNAs having a structure with three deoxynucleotides located at positions 4, 6 and 8 in the seed region of the antisense strand provided unexpectedly increased gene knockdown activity as compared to a GST-π siRNA without deoxynucleotides in the duplex region.

The activity shown in Table 11 for GST-π siRNAs having three deoxynucleotides in the seed region of the antisense strand was in the picomolar range at 11 pM, which is exceptionally suitable for many uses, including as a drug agent to be used in vivo.

Example 7

The structure of GST-π siRNAs having deoxynucleotides located in the seed region of the antisense strand of the siRNA provided unexpectedly and advantageously increased gene knockdown activity in vitro.

In vitro transfection was performed in an A549 cell line to determine knockdown efficacy for GST-π siRNAs based on structure B4' (SEQ ID NOs:1476 and 1488). Dose dependent knockdown of GST-π mRNA was observed with the GST-π siRNAs based on structure B4', as shown in Table 12.

TABLE 12

Dose dependent knockdown of GST-π mRNA in an A549 cell line for GST-π siRNAs based on structure B4'

| GST-π siRNA structure | IC50 (pM) |
|---|---|
| B4 with no deoxynucleotides in the duplex region (SEQ ID NOs: 1269 and 1334) | 229 |
| B4 with deoxynucleotides in positions 3-8 of the seed region antisense strand (SEQ ID NOs: 1480 and 1492) | 113 |

As shown in Table 12, the activities of GST-π siRNAs based on structure B4' having six deoxynucleotides in the seed region of the antisense strand were unexpectedly increased by more than two-fold, as compared to a GST-π siRNA without deoxynucleotides in the duplex region.

These data show that GST-π siRNAs having a structure with six deoxynucleotides located at positions 3-8 in the seed region of the antisense strand provided surprisingly increased gene knockdown activity as compared to a GST-π siRNA without deoxynucleotides in the duplex region.

The activity shown in Table 12 for a GST-π siRNA having six deoxynucleotides in the seed region of the antisense strand was in the picomolar range at 113 pM, which is exceptionally suitable for many uses, including as a drug agent to be used in vivo.

Example 8

The structure of GST-π siRNAs having deoxynucleotides located in the seed region of the antisense strand of the siRNA provided unexpectedly and advantageously increased gene knockdown activity in vitro.

In vitro transfection was performed in an A549 cell line to determine knockdown efficacy for GST-π siRNAs based on structure B2' (SEQ ID NOs:1452 and 1464). Dose dependent knockdown of GST-π mRNA was observed with the GST-π siRNAs based on structure B2', as shown in Table 13.

TABLE 13

Dose dependent knockdown of GST-π mRNA in an A549 cell line for GST-π siRNAs based on structure B2'

| GST-π siRNA structure | IC50 (pM) |
|---|---|
| B2 with no deoxynucleotides in the duplex regioin (SEQ ID NOs: 1267 and 1332) | 121 |
| B2 with deoxynucleotides in positions 5-8 of the seed region antisense strand (SEQ ID NOs: 1458 and 1470) | 30 |
| B2 with deoxynucleotides in positions 1, 3, 5, and 7 of the seed region antisense strand (SEQ ID NOs: 1459 and 1471) | 50 |
| B2 with deoxynucleotides in positions 3, 5, and 7 of the seed region antisense strand (SEQ ID NOs: 1460 and 1472) | 100 |

As shown in Table 13, the activities of GST-π siRNAs based on structure B2' having three to four deoxynucleotides in the seed region of the antisense strand were surprisingly increased by up to 4-fold, as compared to a GST-π siRNA without deoxynucleotides in the duplex region.

These data show that GST-π siRNAs having a structure with three to four deoxynucleotides located at positions 5-8, or at positions 1, 3, 5 and 7, or at positions 3, 5 and 7 in the seed region of the antisense strand provided unexpectedly increased gene knockdown activity as compared to a GST-π siRNA without deoxynucleotides in the duplex region.

The activities shown in Table 13 for GST-π siRNAs having three to four deoxynucleotides in the seed region of the antisense strand were in the range 30-100 pM, which is exceptionally suitable for many uses, including as a drug agent to be used in vivo.

Example 9

The structure of GST-π siRNAs containing one or more 2'-deoxy-2'-fluoro substituted nucleotides provided unexpectedly increased gene knockdown activity in vitro.

In vitro transfection was performed in an A549 cell line to determine knockdown efficacy for GST-π siRNAs based on structure BU2' (SEQ ID NOs:1346 and 1372). Dose dependent knockdown of GST-π mRNA was observed with the GST-π siRNAs based on structure BU2', as shown in Table 14.

TABLE 14

Dose dependent knockdown of GST-π mRNA in an A549 cell line for GST-π siRNAs based on structure BU2'

| GST-π siRNA structure | IC50 (pM) |
|---|---|
| BU2 with no 2'-F deoxynucleotides (SEQ ID NOs: 1276 and 1341) | 31 |
| BU2 with seven 2'-F deoxynucleotides, one in position 1 at the 3'end of the antisense strand (SEQ ID NOs: 1363 and 1389) | 3 |
| BU2 with four 2'-F deoxynucleotides, one in position 1 at the 3'end of the antisense strand (SEQ ID NOs: 1362 and 1388) | 11 |
| BU2 with one 2'-F deoxynucleotide in position 1 at the 3'end of the antisense strand (SEQ ID NOs: 1359 and 1385) | 13 |

As shown in Table 14, the activities of GST-π siRNAs based on structure BU2' having one or more 2'-F deoxynucleotides were surprisingly increased by up to 10-fold, as compared to a GST-π siRNA without 2'-F deoxynucleotides.

These data show that GST-π siRNAs having a structure with one or more 2'-F deoxynucleotides provided unexpectedly increased gene knockdown activity as compared to a GST-π siRNA without a 2'-F deoxynucleotide.

The activities shown in Table 14 for GST-π siRNAs having one or more 2'-F deoxynucleotides were in the range 3 to 13 pM, which is exceptionally suitable for many uses, including as a drug agent to be used in vivo.

Example 10

The structure of GST-π siRNAs containing one or more 2'-deoxy-2'-fluoro substituted nucleotides provided unexpectedly increased gene knockdown activity in vitro.

In vitro transfection was performed in an A549 cell line to determine knockdown efficacy for GST-π siRNAs based on structure B13' (SEQ ID NOs:1422 and 1437). Dose dependent knockdown of GST-π mRNA was observed with the GST-π siRNAs based on structure B13', as shown in Table 15.

TABLE 15

Dose dependent knockdown of GST-π mRNA in an A549 cell line for GST-π siRNAs based on structure B13'

| GST-π siRNA structure | IC50 (pM) |
|---|---|
| B13 with no 2'-F deoxynucleotides (SEQ ID NOs: 1265 and 1330) | 17 |
| B13 with three 2'-F deoxynucleotides located in non-overhang positions (SEQ ID NOs: 1434 and 1449) | 6 |

As shown in Table 15, the activity of a GST-π siRNA based on structure B13' having three 2'-F deoxynucleotides located in non-overhang positions was surprisingly increased by about 3-fold, as compared to a GST-π siRNA without 2'-F deoxynucleotides.

These data show that GST-π siRNAs having a structure with one or more 2'-F deoxynucleotides provided unexpectedly increased gene knockdown activity as compared to a GST-π siRNA without a 2'-F deoxynucleotide.

The activity shown in Table 15 for GST-π siRNAs having one or more 2'-F deoxynucleotides was in the picomolar range at 6 pM, which is exceptionally suitable for many uses, including as a drug agent to be used in vivo.

Example 11

Orthotopic A549 Lung Cancer Mouse Model

The GST-π siRNAs of this invention can exhibit profound reduction of orthotopic lung cancer tumors in vivo. In this example, a GST-π siRNA provided gene knockdown potency in vivo when administered in a liposomal formulation to the orthotopic lung cancer tumors in athymic nude mice.

In general, an orthotopic tumor model can exhibit direct clinical relevance for drug efficacy and potency, as well as improved predictive ability. In the orthotopic tumor model, tumor cells are implanted directly into the same kind of organ from which the cells originated.

The anti-tumor efficacy of the siRNA formulation against human lung cancer A549 was evaluated by comparing the final primary tumor weights measured at necropsy for the treatment group and the vehicle control group.

Figure 4:
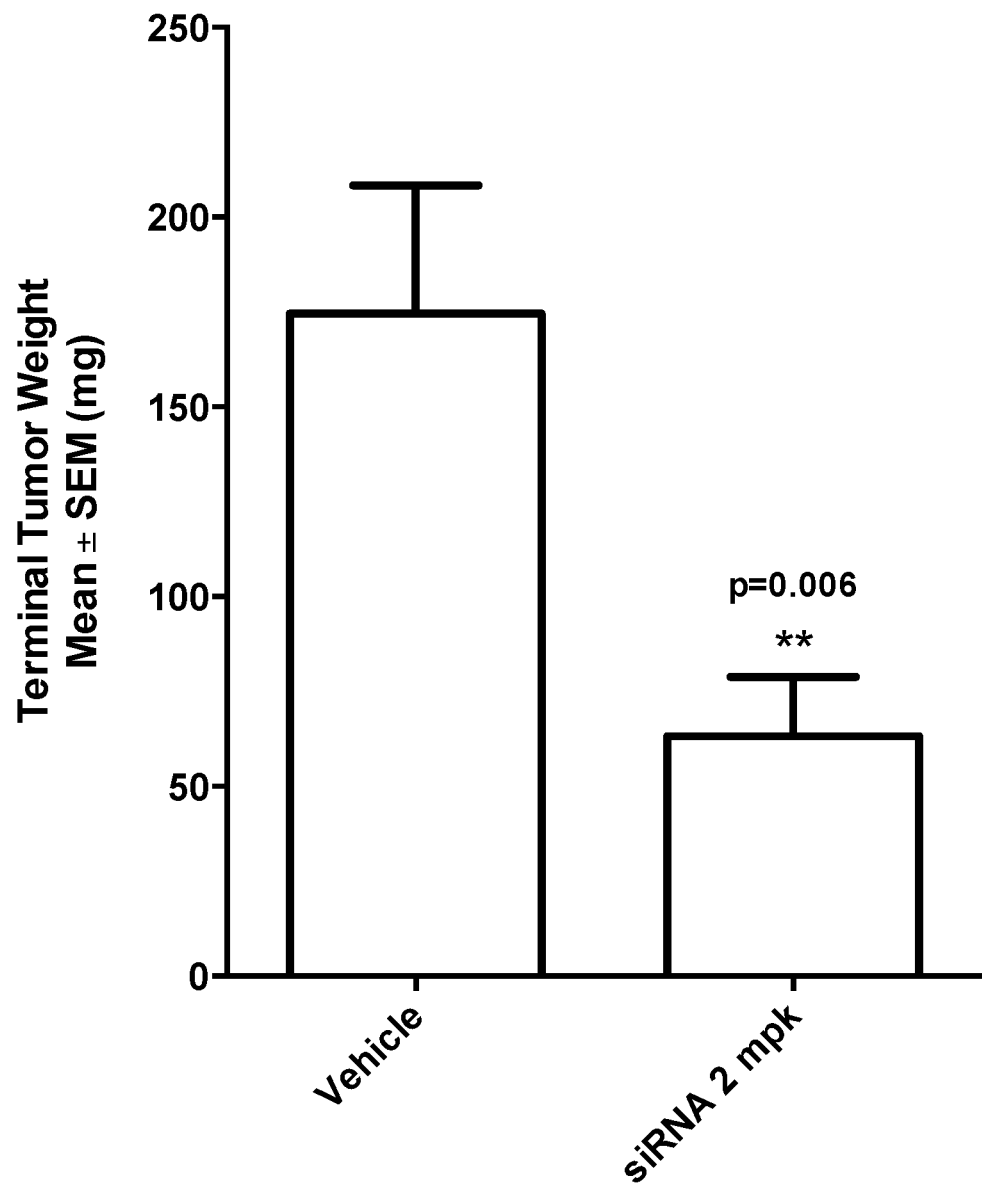
FIG. 4 shows the profound reduction of orthotopic lung cancer tumors in vivo by a siRNA of this invention targeted to GST-π. The GST-π siRNA was administered in a liposomal formulation at a dose of 2 mg/kg to athymic nude mice presenting A549 orthotopic lung cancer tumors. Final primary tumor weights were measured at necropsy for the treatment group and a vehicle control group. The GST-π siRNA showed significant efficacy for inhibition of lung cancer tumors in this six-week study.

FIG. 4 shows orthotopic lung cancer tumor inhibition in vivo for a GST-π siRNA based on structure BU2 (SEQ ID NOs:1276 and 1341). An orthotopic A549 lung cancer mouse model was utilized with a relatively low dose at 2 mg/kg of the siRNA targeted to GST-π.

The GST-π siRNA showed significant and unexpectedly advantageous lung tumor inhibition efficacy in this six-week study. As shown in FIG. 4, after 43 days, the GST-π siRNA showed markedly advantageous tumor inhibition efficacy, with final tumor average weights significantly reduced by 2.8-fold as compared to control.

For this study, male NCr nu/nu mice, 5-6 weeks old, were used. The experimental animals were maintained in a HEPA filtered environment during the experimental period. The siRNA formulations were stored at 4° C. before use, and warmed to room temperature 10 minutes prior to injection in mouse.

For this A549 human lung cancer orthotopic model, on the day of surgical orthotopic implantation (SOI), the stock tumors were harvested from the subcutaneous site of animals bearing A549 tumor xenograft and placed in RPMI-1640 medium. Necrotic tissues were removed and viable tissues were cut into 1.5-2 mm³ pieces. The animals were anesthetized with isoflurane inhalation and the surgical area was sterilized with iodine and alcohol. A transverse incision approximately 1.5 cm long was made in the left chest wall of the mouse using a pair of surgical scissors. An intercostal incision was made between the third and the fourth rib and the left lung was exposed. One A549 tumor fragment was transplanted to the surface of the lung with an 8-0 surgical suture (nylon). The chest wall was closed with a 6-0 surgical suture (silk). The lung was re-inflated by intrathoracic puncture using a 3 cc syringe with a 25 G×1½ needle to draw out the remaining air in the chest cavity. The chest wall was closed with a 6-0 surgical silk suture. All procedures of the operation described above were performed with a 7× magnification microscope under HEPA filtered laminar flow hoods.

Three days after tumor implantation, the model tumor-bearing mice were randomly divided into groups of ten mice per group. For the group of interest, treatment of the ten mice was initiated three days after tumor implantation.

For the group of interest, the formulation was (Ionizable lipid:cholesterol:DOPE:DOPC:DPPE-PEG-2K:DSPE-PEG-2K), a liposomal composition. The liposomes encapsulated the GST-π siRNA.

For the study endpoint, the experimental mice were sacrificed forty-two days after treatment initiation. Primary tumors were excised and weighed on an electronic balance for subsequent analysis.

For an estimation of compound toxicity, the mean body weight of the mice in the treated and control groups was maintained within the normal range during the entire experimental period. Other symptoms of toxicity were not observed in the mice.

Example 12

The GST-π siRNAs of this invention exhibited profound reduction of cancer xenograft tumors in vivo. The GST-π siRNAs provided gene knockdown potency in vivo when administered in a liposomal formulation to the cancer xenograft tumors.

Figure 5:
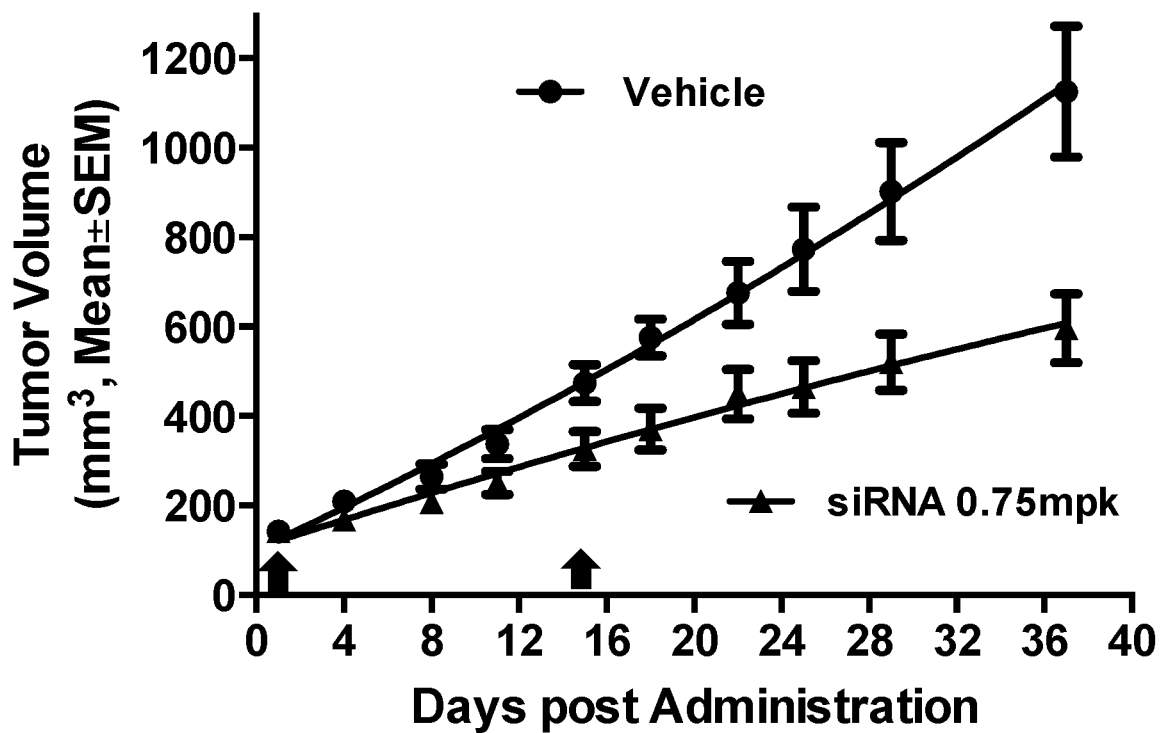
FIG. 5 shows tumor inhibition efficacy in vivo for a GST-π siRNA. A cancer xenograft model using A549 cells was utilized with a relatively low dose of siRNA at 0.75 mg/kg. The GST-π siRNA showed advantageous tumor inhibition within a few days. After 36 days, the GST-π siRNA showed markedly advantageous tumor inhibition, with final tumor average volumes significantly reduced by about 2-fold, as compared to control.

FIG. 5 shows tumor inhibition efficacy for a GST-π siRNA (SEQ ID Nos:1371 and 1397). A cancer xenograft model was utilized with a relatively low dose at 0.75 mg/kg of siRNA targeted to GST-π.

The GST-π siRNA showed significant and unexpectedly advantageous tumor inhibition efficacy within a few days after administration. After 36 days, the GST-π C siRNA showed markedly advantageous tumor inhibition efficacy, with tumor volume reduced by 2-fold as compared to control.

Figure 6:
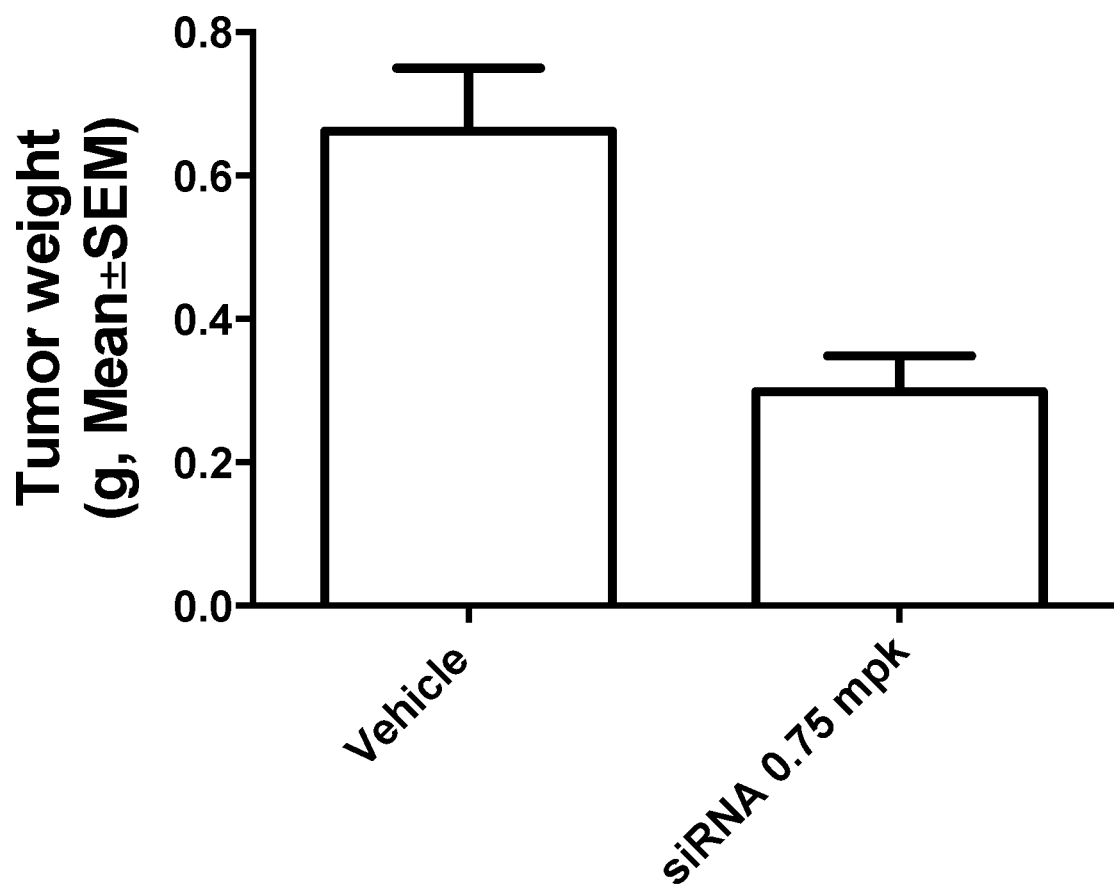
FIG. 6 shows tumor inhibition efficacy in vivo for a GST-π siRNA at the endpoint of FIG. 5. The GST-π siRNA showed advantageous tumor inhibition with average tumor weights reduced by more than 2-fold.

As shown in FIG. 6, the GST-π siRNA demonstrated significant and unexpectedly advantageous tumor inhibition efficacy at the endpoint day. In particular, tumor weight was reduced by more than 2-fold.

The GST-π siRNA was administered in two injections (day 1 and 15) of a liposomal formulation having the composition (Ionizable lipid:Cholesterol:DOPE:DOPC:DPPE-PEG-2K) (25:30:20:20:5).

For the cancer xenograft model, an A549 cell line was obtained from ATCC. The cells were maintained in culture medium supplemented with 10% Fetal Bovine Serum and 100 U/ml penicillin and 100 µg/ml streptomycin. Cells were split 48 hrs before inoculation so that cells were in log phase growth when harvested. Cells were lightly trypsinized with trypsin-EDTA and harvested from tissue culture. The number of viable cells was counted and determined in a hemocytometer in the presence of trypan blue (only viable cells are counted). The cells were resuspended to a concentration of 5×10⁷/ml in media without serum. Then the cell suspension was mixed well with ice thawed BD matrigel at 1:1 ratio for injection.

Mice were Charles River Laboratory Athymic Nude (nu/nu) Female Mice, immuno-compromised, 6-8 weeks old, 7-8 mice per group.

For tumor model preparation, each mouse was inoculated subcutaneously in the right flank with 0.1 ml an inoculum of 2.5×10$^6$ of A549 cells using a 25 G needle and syringe, one inoculum per mouse. Mice were not anesthetized for inoculation.

For tumor volume measurements and randomization, tumor size was measured to the nearest 0.1 mm. Tumor volumes were calculated using the formula: Tumor volume=length×width$^2$/2. Once the established tumors reached approximately 120-175 mm$^3$, average tumor volume was about 150 mm$^3$, the mice were assigned into the various vehicle control and treatment groups such that the mean tumor volumes in the treated groups were within 10% of the mean tumor volume in the vehicle control group, ideally, the CV % of tumor volume was less than 25%. On the same day, test articles and control vehicle were administered according to the dosing regimen. Tumor volumes were monitored three times for week 1, twice for the rest of weeks, including the day of study termination.

For dosage administration, on the dosing day, the test articles were taken out from −80° C. freezer and thawed on ice. Before applied to syringes, the bottle containing formulation was reverted by hands for a few times. All test articles were dosed at 0.75 mg/kg by IV, q2w×2, at 10 ml/kg.

For body weight, mice were weighed to the nearest 0.1 g. Body weights were monitored and recorded daily within 7 days post dosing for first dose. Body weights were monitored and recorded twice for weeks, for the rest of weeks, including the day of study termination.

For tumors collection, on 28 days post first dosing, tumor volume was measured, and tumor was dissected for weight measurement, and stored for PD biomarker study. Tumor weight was recorded.

Example 13

The GST-π siRNAs of this invention demonstrated increased cancer cell death by apoptosis of cancer cells in vitro. The GST-π siRNAs provided GST-π knockdown, which resulted in upregulation of PUMA, a biomarker for apoptosis and associated with loss in cell viability.

GST-π siRNA SEQ ID NOs:1371 and 1397, which contained a combination of deoxynucleotides in the seed region, a 2'-F substituted deoxynucleotide, and 2'-OMe substituted ribonucleotides, provided unexpectedly increased apoptosis of cancer cells.

Figure 7:
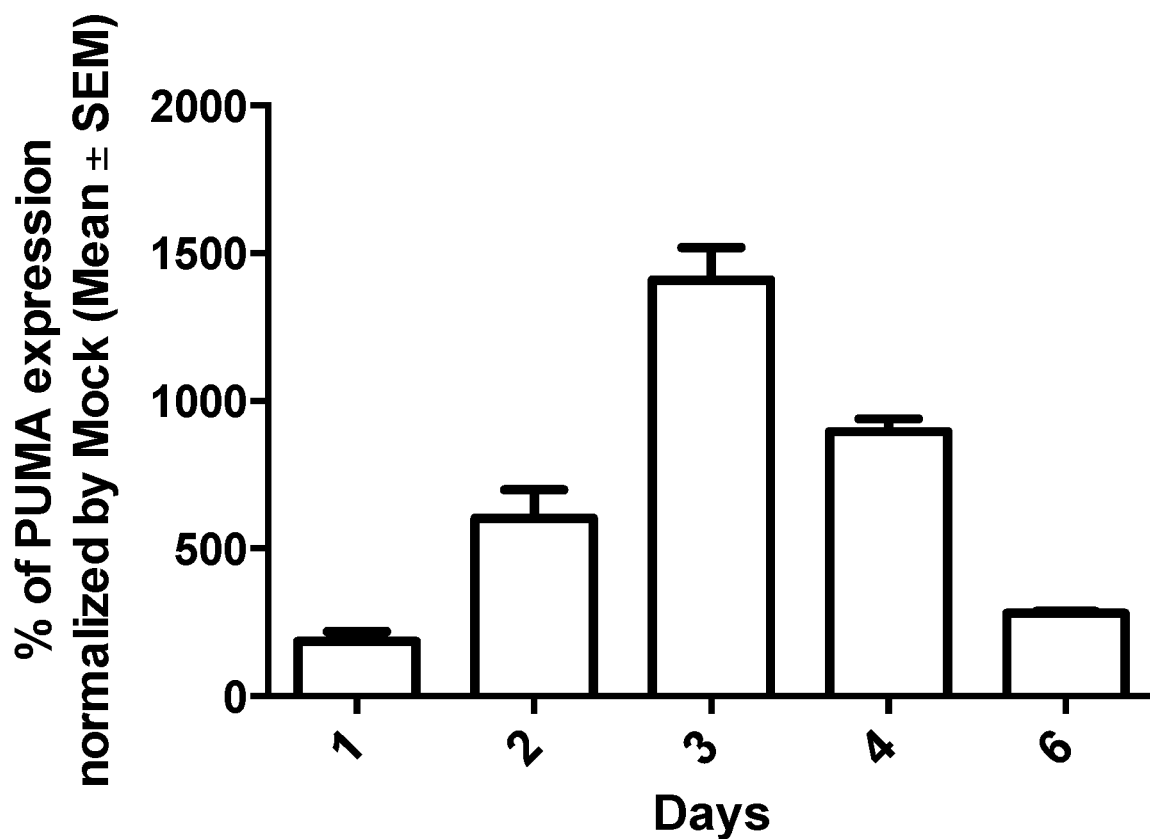
FIG. 7 shows that a GST-π siRNA of this invention greatly increased cancer cell death by apoptosis in vitro. The GST-π siRNA caused upregulation of PUMA, a biomarker for apoptosis, which is associated with loss in cell viability.

The level of expression of PUMA for GST-π siRNA SEQ ID NOs:1371 and 1397 was measured as shown in FIG. 7. In FIG. 7, the expression of PUMA was greatly increased from 2-4 days after transfection of the GST-π siRNA.

These data show that the structure of GST-π siRNAs containing a combination of deoxynucleotides in the seed region, a 2'-F substituted deoxynucleotide, and 2'-OMe substituted ribonucleotides provided unexpectedly increased apoptosis of cancer cells.

The protocol for the PUMA biomarker was as follows. One day before transfection, cells were plated in a 96-well plate at 2×10$^3$ cells per well with 100 μl of DMEM (HyClone Cat. #SH30243.01) containing 10% FBS and cultured in a 37° C. incubator containing a humidified atmosphere of 5% CO2 in air. Next day, before transfection the medium was replaced with 90 μl of Opti-MEM I Reduced Serum Medium (Life Technologies Cat. #31985-070) containing 2% FBS. Then, 0.2 μl of Lipofectamine RNAiMAX (Life Technologies Cat. #13778-100) were mixed with 4.8 μl of Opti-MEM I for 5 minutes at room temperature. 1 μl of the GST-π siRNA (stock conc. 1 μM) was mixed with 4 μl of Opti-MEM I and combined with the RNAiMAX solution and then mixed gently. The mixture was incubated for 10 minutes at room temperature to allow the RNA-RNAiMAX complexes to form. 10 μl of RNA-RNAiMAX complexes were added per well, to final concentration of the siRNA 10 nM. The cells were incubated for 2 hours and medium changed to fresh Opti-MEM I Reduced Serum Medium containing 2% FBS. For 1, 2, 3, 4, and 6 days post transfection, the cells were washed with ice-cold PBS once and then lysed with 50 μl of Cell-to-Ct Lysis Buffer (Life Technologies Cat. #4391851 C) for 5-30 minutes at room temperature. 5 μl of Stop Solution was added and incubated for 2 minutes at room temperature. PUMA (BBC3, Cat #Hs00248075, Life Technologies) mRNA levels were measured by qPCR with TAQMAN.

Example 14

The GST-π siRNAs of this invention can exhibit profound reduction of cancer xenograft tumors in vivo. The GST-π siRNAs can provide gene knockdown potency in vivo when administered in a liposomal formulation to the cancer xenograft tumors.

Figure 8:
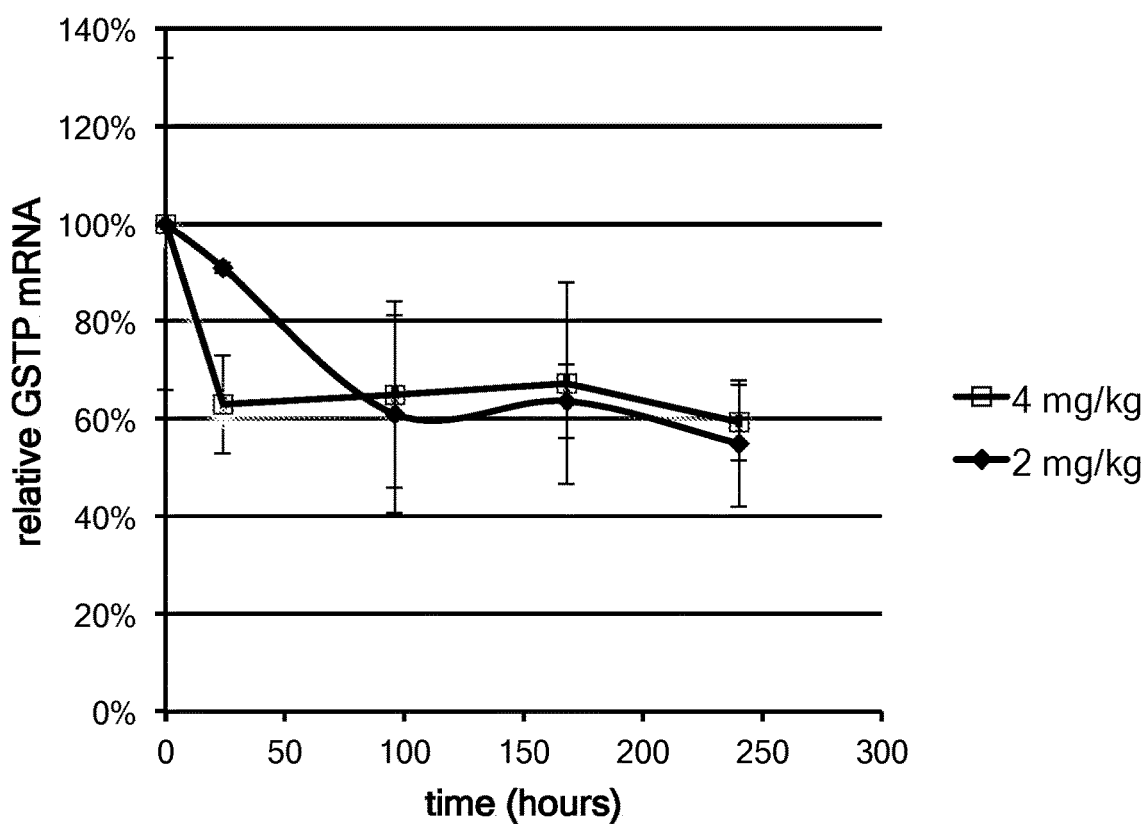
FIG. 8 shows that a GST-π siRNA of this invention provided knockdown efficacy for A549 xenograft tumors in vivo. Dose dependent knockdown of GST-π mRNA was observed in athymic nude (nu/nu) female mice (Charles River) with the siRNA targeted to GST-π.

FIG. 8 shows tumor inhibition efficacy for a GST-π siRNA (SEQ ID NOs:1276 and 1341). Dose dependent knockdown of GST-π mRNA was observed in vivo with the siRNA targeted to GST-π. A cancer xenograft model was utilized with a siRNA targeted to GST-π.

The GST-π siRNA showed significant and unexpectedly advantageous tumor inhibition efficacy within a few days after administration. As shown in FIG. 8, treatment with a GST-π siRNA resulted in significant reduction of GST-π mRNA expression 4 days after injection in a lipid formulation. At the higher dose of 4 mg/kg, significant reduction of about 40% was detected 24 hours after injection.

The GST-π siRNA was administered in a single injection of 10 mL/kg of a liposomal formulation having the composition (Ionizable lipid:Cholesterol:DOPE:DOPC:DPPE-PEG-2K) (25:30:20:20:5).

For the cancer xenograft model, an A549 cell line was obtained from ATCC. The cells were maintained in RPMI-1640 supplemented with 10% Fetal Bovine Serum and 100 U/ml penicillin and 100 μg/ml streptomycin. Cells were split 48 hrs before inoculation so that cells were in log phase growth when harvested. Cells were lightly trypsinized with trypsin-EDTA and harvested from tissue culture. The number of viable cells was counted and determined in a hemocytometer in the presence of trypan blue (only viable cells are counted). The cells were resuspended to a concentration of 4×10⁷/ml in RPMI media without serum. Then the cell suspension was mixed well with ice thawed BD matrigel at 1:1 ratio for injection.

Mice were Charles River Laboratory Athymic Nude (nu/nu) Female Mice, immuno-compromised, 6-8 weeks old, 3 mice per group.

For tumor model preparation, each mouse was inoculated subcutaneously in the right flank with 0.1 ml an inoculum of 2×10$^6$ of A549 cells using a 25 G needle and syringe, one inoculum per mouse. Mice were not anesthetized for inoculation.

For tumor volume measurements and randomization, tumor size was measured to the nearest 0.1 mm. Tumor volumes were calculated using the formula: Tumor volume=length×width$^2$/2. Tumor volumes were monitored twice a week. Once the established tumors reached approximately 350-600 mm$^3$, the mice were assigned into groups with varied time points. On the same day, test articles were administered according to the dosing regimen.

For dosage administration, on the day when the established tumors reached approximately 350-600 mm$^3$, the test articles were taken out from 4° C. fridge. Before being applied to syringes, the bottle containing formulation was reverted by hand for a few times to make a homogeneous solution.

For body weight, mice were weighed to the nearest 0.1 g. Body weights were monitored and recorded twice for weeks, for the rest of weeks, including the day of study termination.

For tumors collection, animals were sacrificed by overdosed $CO_2$ and tumors were dissected at 0, 24, 48, 72, 96 (optional), and 168 hours following the dosing. Tumors were first wet weighted, and then separated into three parts for KD, distribution and biomarker analysis. The samples were snap frozen in liquid nitrogen and stored at −80° C. until ready to be processed.

Example 15

The GST-π siRNAs of this invention inhibited pancreatic cancer xenograft tumors in vivo. The GST-π siRNAs provided gene knockdown potency in vivo when administered in a liposomal formulation to the pancreatic cancer xenograft tumors.

In this xenograft model, each mouse was inoculated subcutaneously in the right flank with 0.1 ml an inoculum of 2.5×10$^6$ of PANC-1 cells. Athymic nude female mice, 6 to 8 weeks, Charles River, were used. Tumor size was measured to the nearest 0.1 mm. Once the established tumors reached approximately 150-250 mm$^3$ (average tumor volume at about 200 mm$^3$), the mice were assigned into the various vehicle control and treatment groups such that the mean tumor volumes in the treated groups were within 10% of the mean tumor volume in the vehicle control group. On the same day, test articles and control vehicle were administered according to the dosing regimen. Tumor volumes were monitored three times for week 1, twice for the rest of weeks, including the day of study termination.

Figure 9:
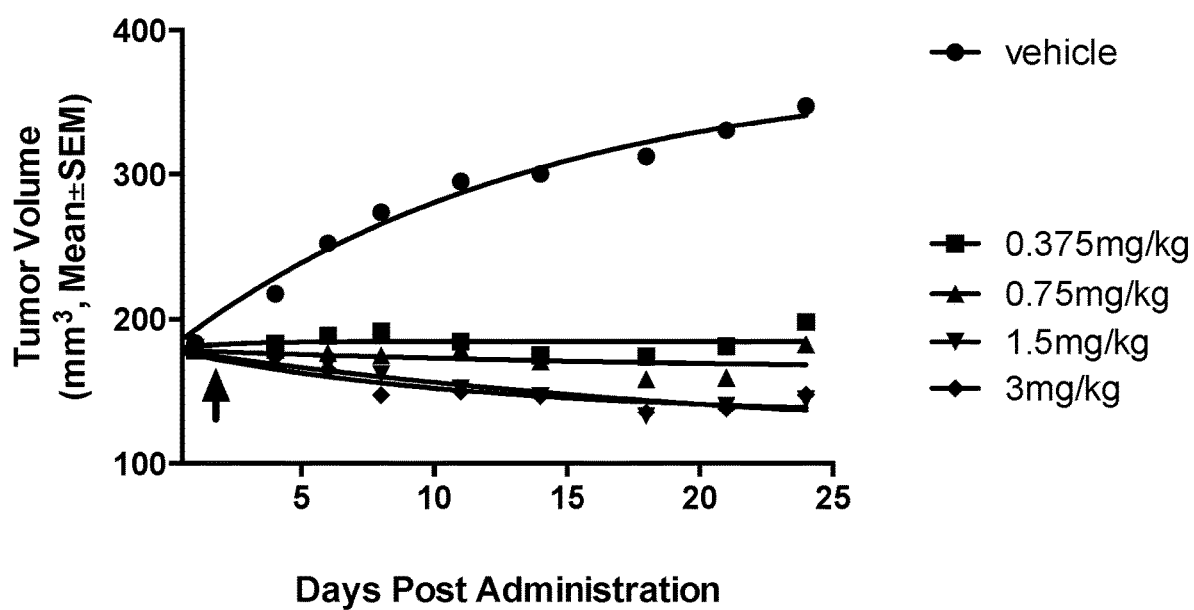
FIG. 9 shows that a GST-π siRNA of this invention inhibited pancreatic cancer xenograft tumors in vivo. The GST-π siRNA provided gene silencing potency in vivo when administered in a liposomal formulation to pancreatic cancer xenograft tumors in athymic nude female mice, 6 to 8 weeks old.

FIG. 9 shows tumor inhibition efficacy for a GST-π siRNA (SEQ ID Nos:1276 and 1341). As shown in FIG. 9, a dose response was obtained with doses ranging from 0.375 mg/kg to 3 mg/kg of siRNA targeted to GST-π. The GST-π siRNA showed significant and unexpectedly advantageous tumor inhibition efficacy within a few days after administration. Thus, the GST-π siRNA demonstrated significant and unexpectedly advantageous tumor inhibition efficacy at the endpoint.

The GST-π siRNAs were administered in a liposomal formulation having the composition (Ionizable lipid:cholesterol:DOPE:DOPC:DPPE-PEG-2K) (25:30:20:20:5).

Example 16

The GST-π siRNAs of this invention exhibited increased serum stability.

FIG. 10 shows incubation in human serum and detection of remaining siRNA at various time points by HPLS/LCMS. As shown in FIG. 10, the half-life ($t_{1/2}$) in serum for both the sense strand (FIG. 10, top) and antisense strand (FIG. 10, bottom) of a GST-π siRNA (SEQ ID Nos:1276 and 1341) was about 100 minutes.

Example 17

The GST-π siRNAs of this invention exhibited enhanced stability in formulation in plasma.

Figure 11:
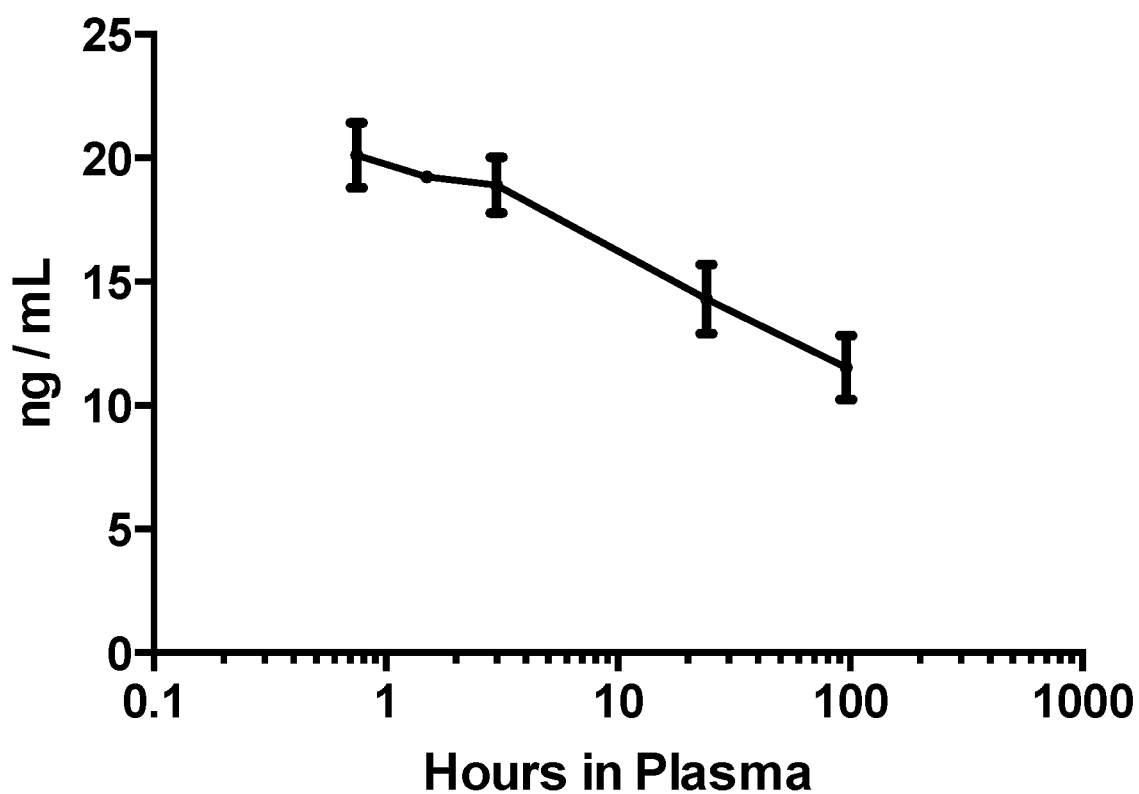
FIG. 11 shows that a GST-π siRNA of this invention exhibited enhanced stability in formulation in plasma.

FIG. 11 shows incubation of formulation in plasma and detection of remaining siRNA at various time points. As shown in FIG. 11, the half-life ($t_{1/2}$) in plasma of a formulation of GST-π siRNA (SEQ ID Nos:1276 and 1341) was significantly longer than 100 hours.

The GST-π siRNA was prepared in a liposomal formulation having the composition (Ionizing lipid:cholesterol:DOPE:DOPC:DPPE-PEG-2K) (25:30:20:20:5). The z-average size for the liposomal nanoparticles was 40.0 nm, and the siRNA was 91% encapsulated.

The formulation was incubated in 50% human serum in PBS for 40 min, 1.5 h, 3 h, 24 h, and 96 h. The amount of the GST-π siRNA was determined by an ELISA-based assay.

Example 18

The GST-π siRNAs of this invention exhibited reduced off target effects by the passenger strand.

Figure 12:
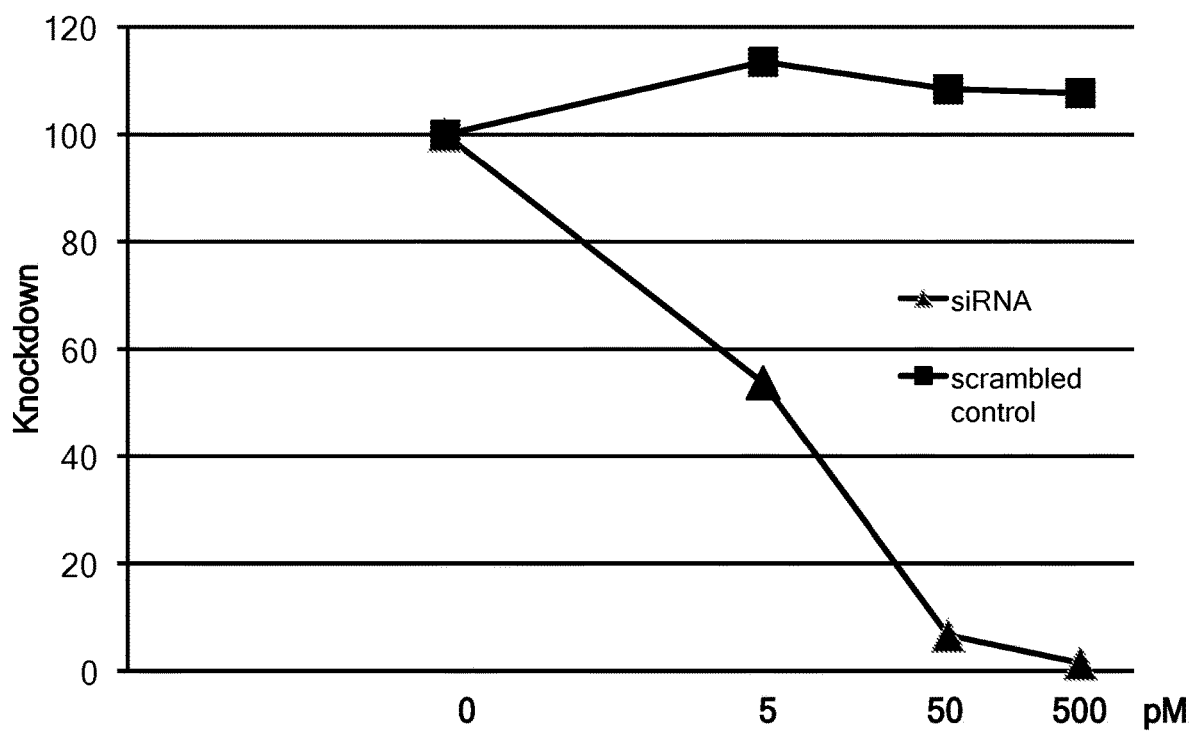
FIG. 12 shows in vitro knockdown for the guide strand of a GST-π C siRNA.
Figure 13:
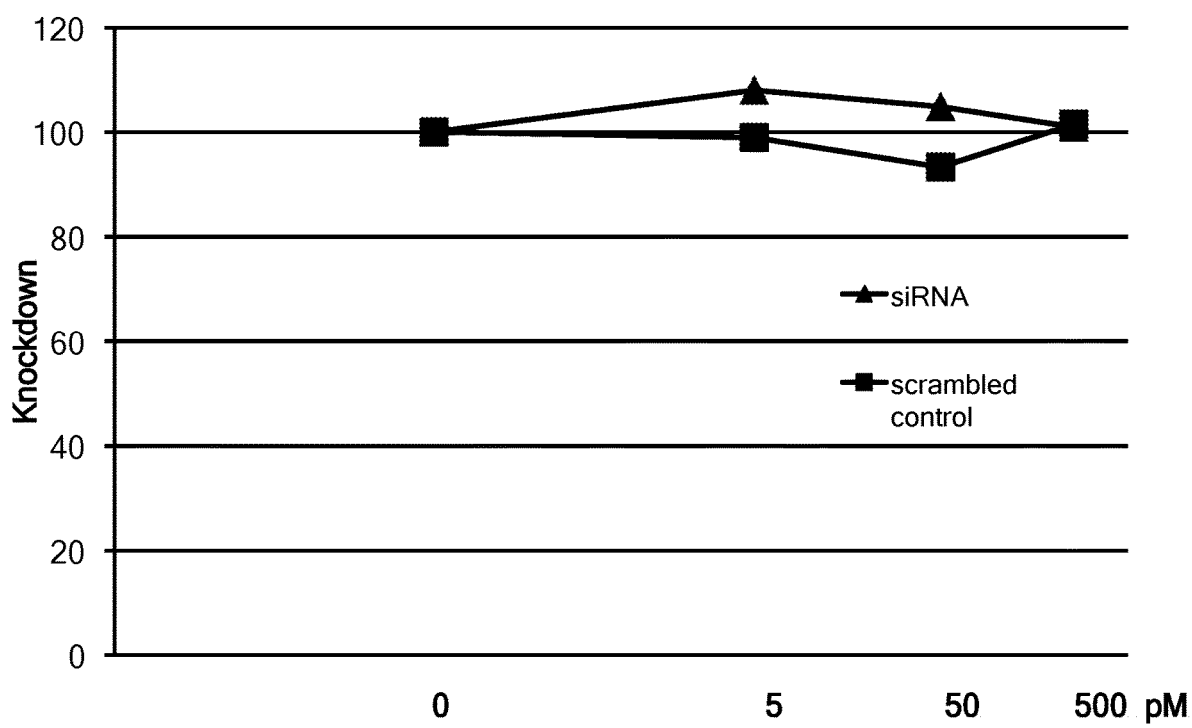
FIG. 13 shows in vitro knockdown for the passenger strand of the GST-π siRNA of FIG. 12.

For the GST-π siRNA (SEQ ID Nos:1371 and 1397), FIG. 12 shows that in vitro knockdown for the guide strand was approximately exponential, as compared to a control with scrambled sequence that exhibited no effect. The IC50 of this siRNA was measured at 5 pM. FIG. 13 shows in vitro knockdown for the passenger strand of the same GST-π siRNA. As shown in FIG. 13, the passenger strand off target knockdown for the GST-π siRNA was greatly reduced, by more than 100-fold.

Figure 14:
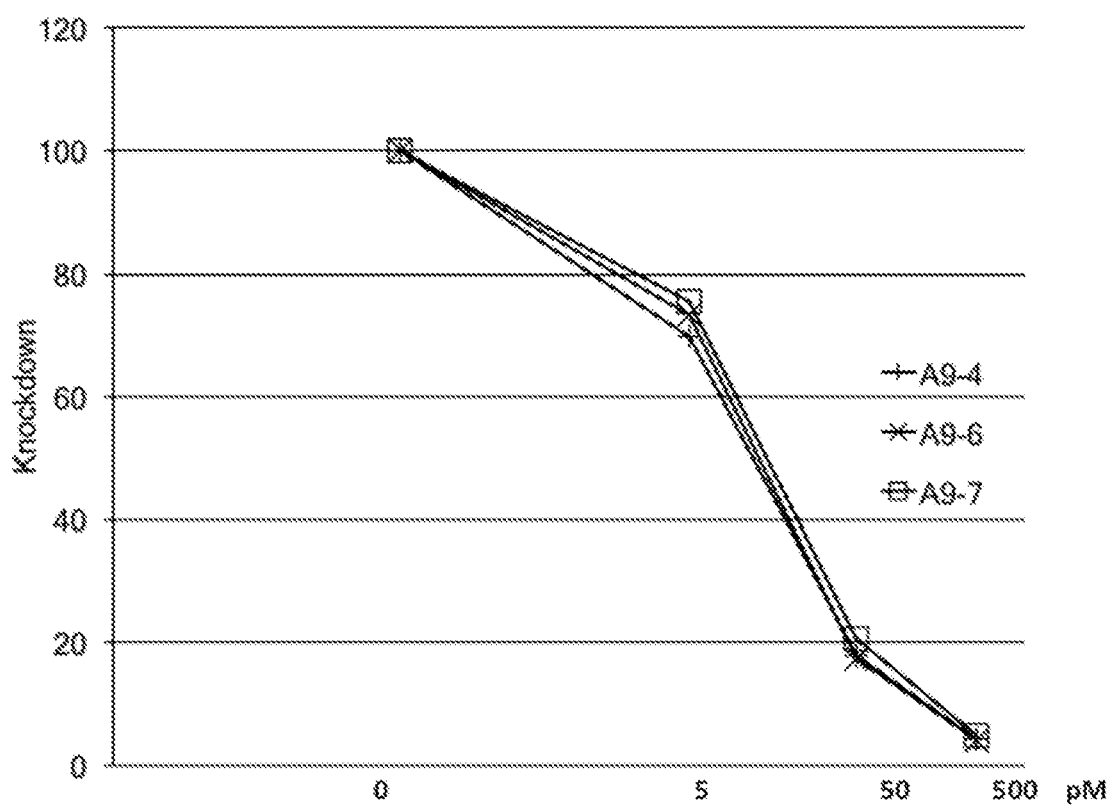
FIG. 14 shows in vitro knockdown for the guide strands of several highly active GST-π siRNAs.
Figure 15:
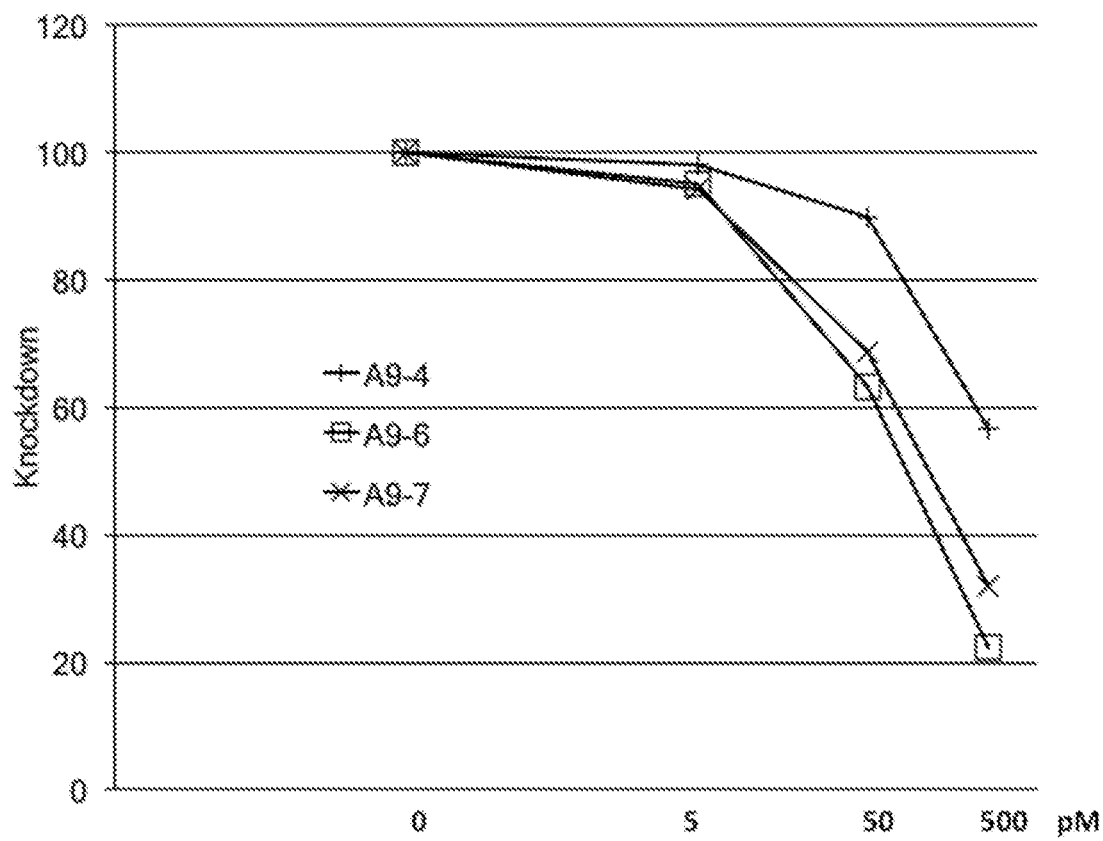
FIG. 15 shows in vitro knockdown for the passenger strand of the GST-π siRNAs of FIG. 14.

For the GST-π siRNAs (SEQ ID Nos:1402 and 1414), (SEQ ID Nos:1404 and 1416), and (SEQ ID Nos:1405 and 1417), FIG. 14 shows that the in vitro knockdowns for the guide strands were approximately exponential. The IC50s of these siRNAs were measured at 6, 7, and 5 pM, respectively. As shown in FIG. 15, the in vitro knockdowns for the passenger strands of these GST-π siRNAs were significantly reduced by at least 10-fold. All of these GST-π siRNAs had deoxynucleotides in the seed region of the duplex region, with no other modifications in the duplex region.

Figure 16:
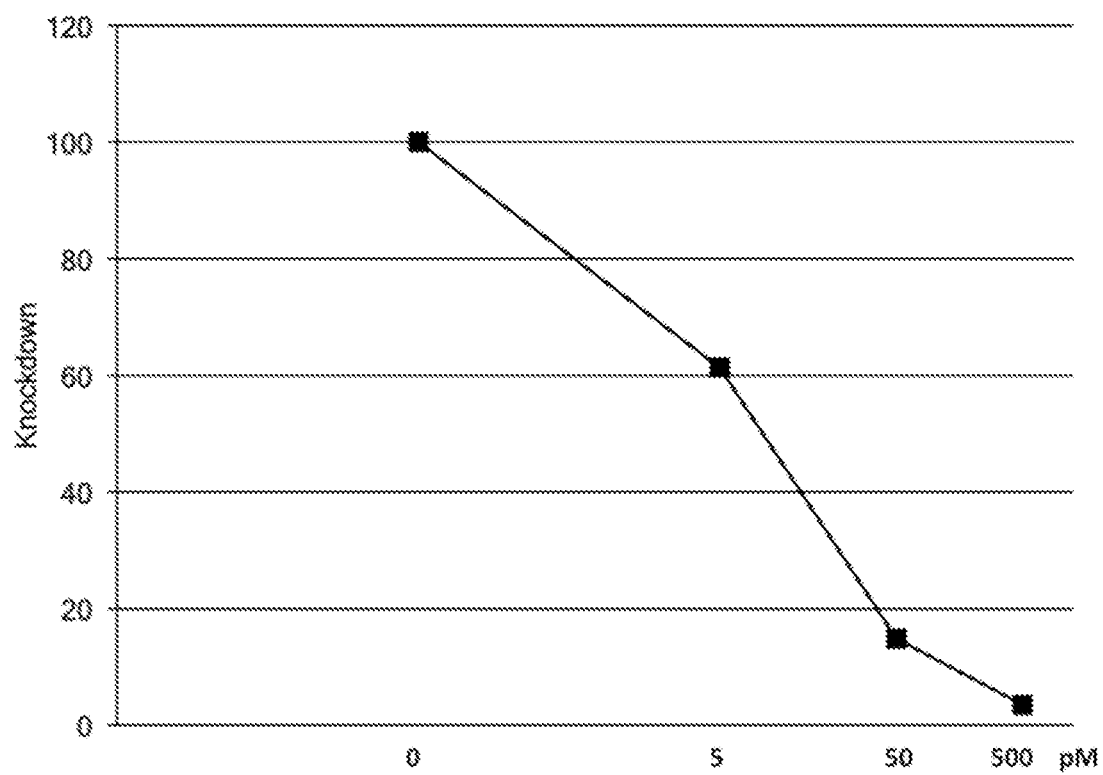
FIG. 16 shows in vitro knockdown for the guide strand of a highly active GST-π siRNA.
Figure 17:
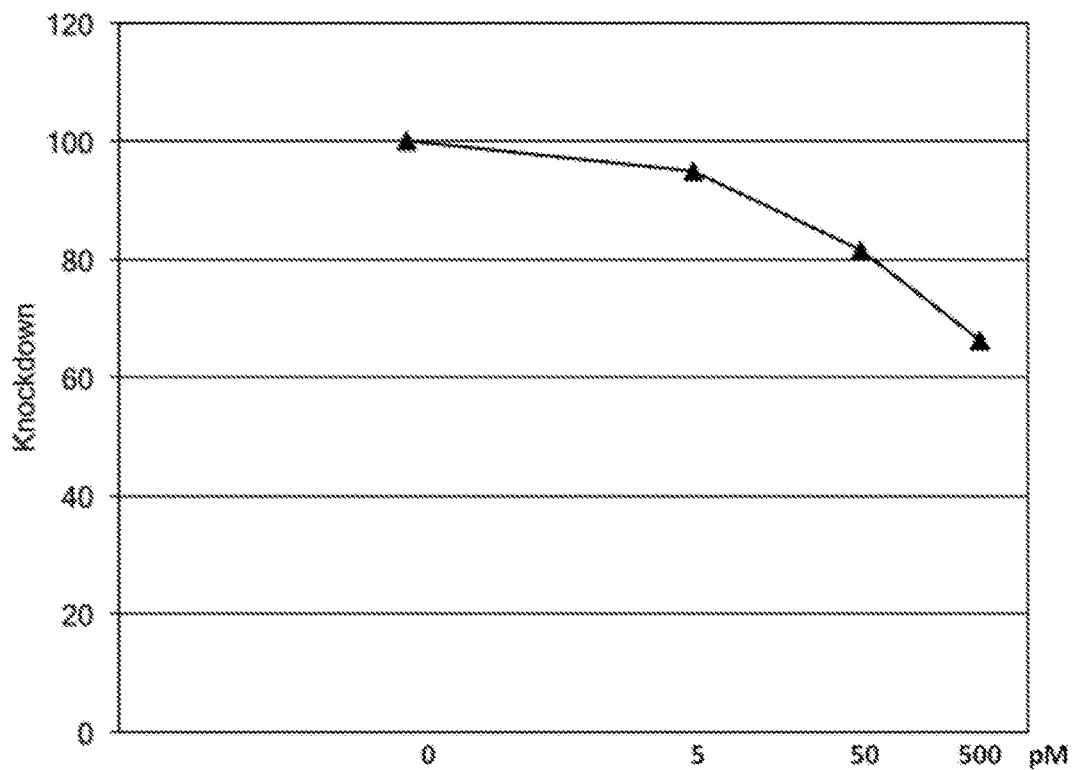
FIG. 17 shows in vitro knockdown for the passenger strand of the GST-π siRNA of FIG. 16.

For the GST-π siRNAs (SEQ ID Nos:1432 and 1447), FIG. 16 shows that the in vitro knockdown for the guide strand of this highly active GST-π siRNA was approximately exponential. The IC50 of this siRNA was measured at 11 pM. As shown in FIG. 17, the in vitro knockdown for the passenger strand of this GST-π siRNA was significantly reduced by more than 100-fold. This GST-π siRNA had deoxynucleotides in the seed region of the duplex region, with no other modifications in the duplex region.

Off-target effects were determined using the expression reporter plasmid psiCHECK-2, which encodes the *Renilla* luciferase gene. (Dual-Luciferase Reporter Assay System, Promega, Cat #:E1960). The siRNA concentration was typically 50 pM. Protocol: Day 1, HeLa cell seeded at 5 to 7.5×10³/100 ul/well. Day 2, co-transfection with cell confluence about 80%. Day 3, cells harvested for luciferase activity measurement. Luciferase activity was measured using Promega's Luciferase Assay System (E4550), according to manufacturer's protocol.

The psiCHECK-2 vector enabled monitoring of changes in expression of a target gene fused to the reporter gene of

*Renilla* luciferase. The siRNA constructs were cloned into the multiple cloning region, and the vector was cotransfected with the siRNA into HeLa cells. If a specific siRNA binds to the target mRNA and initiates the RNAi process, the fused *Renilla* luciferase: construct mRNA will be cleaved and subsequently degraded, decreasing the *Renilla* luciferase signal.

For example, the plasmid inserts for siRNAs with the BU2' structure were as follows:

```
PsiCHECK-2 (F) plasmid insert:
                                  SEQ ID NO.: 1500
ctcgag gggcaacTGAAGCCTTTTGAGACCCTGcTgTcccag gcggccgc PsiCHECK-2 (R) plasmid insert:
                                  SEQ ID NO.: 1501
ctcgag cTgggacagCAGGGTCTCAAAAGGCTTCagTTgccc gcggccgc
```

Example 19

The GST-π siRNAs of this invention exhibited advantageously reduced miRNA-like off target effects, which are seed-dependent unintended off-target gene silencing.

For the GST-π siRNAs (SEQ ID Nos:1371 and 1397), (SEQ ID Nos:1402 and 1414), (SEQ ID Nos:1404 and 1416), (SEQ ID Nos:1405 and 1417), and (SEQ ID Nos: 1432 and 1447), off target activity mimicking miRNA was found to be essentially negligible. The seed-dependent unintended off-target gene silencing for these GST-π siRNAs was at least 10-fold to 100-fold less than the on-target activity of the guide strand.

For testing miRNA-related off target effects, one to four repeats of seed-matched target sequences complementary to the entire seed-containing region, positions 1-8 of the 5' end of the antisense strand, but not to the remaining non-seed region, positions 9-21, were introduced into the region corresponding to the 3'UTR of the luciferase mRNA, to determine the efficiency of the seed-dependent unintended off-target effects. Plasmid inserts were used to mimic a miRNA with complete matching in the seed region and mismatches (bulges) in the non-seed region.

For example, the plasmid inserts for siRNAs with the BU2' structure were as follows:

```
PsiCHECK-2 (Fmi1) plasmid insert:
                                  SEQ ID NO.: 1502
ctcgag gggcaacTCTACGCAAAACAGACCCTGcTgTcccag gcggccgc PsiCHECK-2 (Fmi2) plasmid insert:
                                  SEQ ID NO.: 1503
ctcgag gggcaacTCTACGCAAAACAGACCCTGcT CTACGCAAAA CAGACCCTGcTgTcccag gcggccgc PsiCHECK-2 (Fmi3) plasmid insert:
                                  SEQ ID NO.: 1504
ctcgag gggcaacTCTACGCAAAACAGACCCTGcT CTACGCAAAACAGACCCTGcT CTACGCAAAACAGACCCTGcTgTcccag gcggccgc
```

-continued

```
PsiCHECK-2 (Fmi4) plasmid insert:
                                  SEQ ID NO.: 1505
ctcgag gggcaacTCTACGCAAAACAGACCCTGcT CTACGCAAAACAGACCCTGcT CTACGCAAAACAGACCCTGcT CTACGCAAAACAGACCCTGcT gTcccag gcggccgc
```

The embodiments described herein are not limiting and one skilled in the art can readily appreciate that specific combinations of the modifications described herein can be tested without undue experimentation toward identifying nucleic acid molecules with improved RNAi activity.

All publications, patents and literature specifically mentioned herein are incorporated by reference in their entirety for all purposes.

It is understood that this invention is not limited to the particular methodology, protocols, materials, and reagents described, as these may vary. It is also to be understood that the terminology used herein is for the purpose of describing particular embodiments only, and is not intended to limit the scope of the present invention. It will be readily apparent to one skilled in the art that varying substitutions and modifications can be made to the description disclosed herein without departing from the scope and spirit of the description, and that those embodiments are within the scope of this description and the appended claims.

It must be noted that as used herein and in the appended claims, the singular forms "a", "an", and "the" include plural reference unless the context clearly dictates otherwise. As well, the terms "a" (or "an"), "one or more" and "at least one" can be used interchangeably herein. It is also to be noted that the terms "comprises," "comprising", "containing," "including", and "having" can be used interchangeably, and shall be read expansively and without limitation.

Recitation of ranges of values herein are merely intended to serve as a shorthand method of referring individually to each separate value falling within the range, unless otherwise indicated herein, and each separate value is incorporated into the specification as if it were individually recited herein. For Markush groups, those skilled in the art will recognize that this description includes the individual members, as well as subgroups of the members of the Markush group.

Without further elaboration, it is believed that one skilled in the art can, based on the above description, utilize the present invention to its fullest extent. The following specific embodiments are, therefore, to be construed as merely illustrative, and not limitative of the remainder of the disclosure in any way whatsoever.

All of the features disclosed in this specification may be combined in any combination. Each feature disclosed in this specification may be replaced by an alternative feature serving the same, equivalent, or similar purpose.

SEQUENCE LISTING (1505 sequences)

SEQ ID NO: 1 - DNA, 986 bp, Homo sapiens
tgggaaagagggaaaggcttccccggccagctgcgcggcgactccggggactccagggcgcccctctgcggccgacgcccggggtgcagcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctaaaaaaaaaaaaaaaaaaaaaaaaaaaaa

SEQ ID NO: 2 - DNA, 21 bp, Artificial Sequence
  Description of Artificial Sequence: Synthetic oligonucleotide
  Description of Combined DNA/RNA Molecule: Synthetic oligonucleotide
gccgcagucuucgccaccatt

SEQ ID NO: 3 - DNA, 21 bp, Artificial Sequence
  Description of Artificial Sequence: Synthetic oligonucleotide
  Description of Combined DNA/RNA Molecule: Synthetic oligonucleotide
ccgcagucuucgccaccautt

SEQ ID NO: 4 - DNA, 21 bp, Artificial Sequence
  Description of Artificial Sequence: Synthetic oligonucleotide
  Description of Combined DNA/RNA Molecule: Synthetic oligonucleotide
cgcagucuucgccaccaugtt

SEQ ID NO: 5 - DNA, 21 bp, Artificial Sequence
  Description of Artificial Sequence: Synthetic oligonucleotide
  Description of Combined DNA/RNA Molecule: Synthetic oligonucleotide
gcagucuucgccaccaugctt

SEQ ID NO: 6 - DNA, 21 bp, Artificial Sequence
  Description of Artificial Sequence: Synthetic oligonucleotide
  Description of Combined DNA/RNA Molecule: Synthetic oligonucleotide
cagucuucgccaccaugcctt

SEQ ID NO: 7 - DNA, 21 bp, Artificial Sequence
  Description of Artificial Sequence: Synthetic oligonucleotide
  Description of Combined DNA/RNA Molecule: Synthetic oligonucleotide
agucuucgccaccaugccgtt

SEQ ID NO: 8 - DNA, 21 bp, Artificial Sequence
  Description of Artificial Sequence: Synthetic oligonucleotide
  Description of Combined DNA/RNA Molecule: Synthetic oligonucleotide
gucuucgccaccaugccgctt

SEQ ID NO: 9 - DNA, 21 bp, Artificial Sequence
  Description of Artificial Sequence: Synthetic oligonucleotide
  Description of Combined DNA/RNA Molecule: Synthetic oligonucleotide
ucuucgccaccaugccgcctt

SEQ ID NO: 10 - DNA, 21 bp, Artificial Sequence
  Description of Artificial Sequence: Synthetic oligonucleotide
  Description of Combined DNA/RNA Molecule: Synthetic oligonucleotide
cuucgccaccaugccgccctt

SEQ ID NO: 11 - DNA, 21 bp, Artificial Sequence
  Description of Artificial Sequence: Synthetic oligonucleotide
  Description of Combined DNA/RNA Molecule: Synthetic oligonucleotide
uucgccaccaugccgcccutt

SEQ ID NO: 12 - DNA, 21 bp, Artificial Sequence
  Description of Artificial Sequence: Synthetic oligonucleotide
  Description of Combined DNA/RNA Molecule: Synthetic oligonucleotide
ucgccaccaugccgcccuatt

SEQ ID NO: 13 - DNA, 21 bp, Artificial Sequence
  Description of Artificial Sequence: Synthetic oligonucleotide
  Description of Combined DNA/RNA Molecule: Synthetic oligonucleotide
cgccaccaugccgcccuactt

SEQ ID NO: 14 - DNA, 21 bp, Artificial Sequence
  Description of Artificial Sequence: Synthetic oligonucleotide
  Description of Combined DNA/RNA Molecule: Synthetic oligonucleotide
gccaccaugccgcccuacatt

SEQ ID NO: 15 - DNA, 21 bp, Artificial Sequence
  Description of Artificial Sequence: Synthetic oligonucleotide
  Description of Combined DNA/RNA Molecule: Synthetic oligonucleotide
ccaccaugccgcccuacactt

SEQ ID NO: 16 - DNA, 21 bp, Artificial Sequence
  Description of Artificial Sequence: Synthetic oligonucleotide
  Description of Combined DNA/RNA Molecule: Synthetic oligonucleotide
caccaugccgcccuacacctt

SEQ ID NO: 17 - DNA, 21 bp, Artificial Sequence
  Description of Artificial Sequence: Synthetic oligonucleotide
  Description of Combined DNA/RNA Molecule: Synthetic oligonucleotide
accaugccgcccuacaccgtt

SEQ ID NO: 18 - DNA, 21 bp, Artificial Sequence
  Description of Artificial Sequence: Synthetic oligonucleotide
  Description of Combined DNA/RNA Molecule: Synthetic oligonucleotide
ccaugccgcccuacaccgutt

SEQ ID NO: 19 - DNA, 21 bp, Artificial Sequence
  Description of Artificial Sequence: Synthetic oligonucleotide
  Description of Combined DNA/RNA Molecule: Synthetic oligonucleotide
caugccgcccuacaccgugtt

SEQ ID NO: 20 - DNA, 21 bp, Artificial Sequence
  Description of Artificial Sequence: Synthetic oligonucleotide
  Description of Combined DNA/RNA Molecule: Synthetic oligonucleotide
augccgcccuacaccguggtt

SEQ ID NO: 21 - DNA, 21 bp, Artificial Sequence
  Description of Artificial Sequence: Synthetic oligonucleotide
  Description of Combined DNA/RNA Molecule: Synthetic oligonucleotide
ugccgcccuacaccguggutt

SEQ ID NO: 22 - DNA, 21 bp, Artificial Sequence
  Description of Artificial Sequence: Synthetic oligonucleotide
  Description of Combined DNA/RNA Molecule: Synthetic oligonucleotide
gccgcccuacaccgugguctt

SEQ ID NO: 23 - DNA, 21 bp, Artificial Sequence
  Description of Artificial Sequence: Synthetic oligonucleotide
  Description of Combined DNA/RNA Molecule: Synthetic oligonucleotide
ccgcccuacaccguggucutt

SEQ ID NO: 24 - DNA, 21 bp, Artificial Sequence
  Description of Artificial Sequence: Synthetic oligonucleotide
  Description of Combined DNA/RNA Molecule: Synthetic oligonucleotide
cgcccuacaccguggucuatt

SEQ ID NO: 25 - DNA, 21 bp, Artificial Sequence
  Description of Artificial Sequence: Synthetic oligonucleotide
  Description of Combined DNA/RNA Molecule: Synthetic oligonucleotide
gcccuacaccguggucuautt

SEQ ID NO: 26 - DNA, 21 bp, Artificial Sequence
  Description of Artificial Sequence: Synthetic oligonucleotide
  Description of Combined DNA/RNA Molecule: Synthetic oligonucleotide
cccuacaccguggucuauutt

SEQ ID NO: 27 - DNA, 21 bp, Artificial Sequence
  Description of Artificial Sequence: Synthetic oligonucleotide
  Description of Combined DNA/RNA Molecule: Synthetic oligonucleotide
ccuacaccguggucuauuutt

SEQ ID NO: 28 - DNA, 21 bp, Artificial Sequence
  Description of Artificial Sequence: Synthetic oligonucleotide
  Description of Combined DNA/RNA Molecule: Synthetic oligonucleotide
cuacaccguggucuauuuctt

SEQ ID NO: 29 - DNA, 21 bp, Artificial Sequence
  Description of Artificial Sequence: Synthetic oligonucleotide
  Description of Combined DNA/RNA Molecule: Synthetic oligonucleotide
uacaccguggucuauuucctt

SEQ ID NO: 30 - DNA, 21 bp, Artificial Sequence
  Description of Artificial Sequence: Synthetic oligonucleotide
  Description of Combined DNA/RNA Molecule: Synthetic oligonucleotide
acaccguggucuauuuccctt

SEQ ID NO: 31 - DNA, 21 bp, Artificial Sequence
  Description of Artificial Sequence: Synthetic oligonucleotide
  Description of Combined DNA/RNA Molecule: Synthetic oligonucleotide
caccguggucuauuucccatt

SEQ ID NO: 32 - DNA, 21 bp, Artificial Sequence
  Description of Artificial Sequence: Synthetic oligonucleotide
  Description of Combined DNA/RNA Molecule: Synthetic oligonucleotide
accguggucuauuucccagtt

SEQ ID NO: 33 - DNA, 21 bp, Artificial Sequence
  Description of Artificial Sequence: Synthetic oligonucleotide
  Description of Combined DNA/RNA Molecule: Synthetic oligonucleotide
ccguggucuauuucccagutt

SEQ ID NO: 34 - DNA, 21 bp, Artificial Sequence
  Description of Artificial Sequence: Synthetic oligonucleotide
  Description of Combined DNA/RNA Molecule: Synthetic oligonucleotide
cguggucuauuucccaguutt

SEQ ID NO: 35 - DNA, 21 bp, Artificial Sequence
  Description of Artificial Sequence: Synthetic oligonucleotide
  Description of Combined DNA/RNA Molecule: Synthetic oligonucleotide
guggucuauuucccaguuctt

SEQ ID NO: 36 - DNA, 21 bp, Artificial Sequence
  Description of Artificial Sequence: Synthetic oligonucleotide
  Description of Combined DNA/RNA Molecule: Synthetic oligonucleotide
uggucuauuucccaguucgtt

SEQ ID NO: 37 - DNA, 21 bp, Artificial Sequence
  Description of Artificial Sequence: Synthetic oligonucleotide
  Description of Combined DNA/RNA Molecule: Synthetic oligonucleotide
ggucuauuucccaguucgatt

SEQ ID NO: 38 - DNA, 21 bp, Artificial Sequence
  Description of Artificial Sequence: Synthetic oligonucleotide
  Description of Combined DNA/RNA Molecule: Synthetic oligonucleotide
gucuauuucccaguucgagtt

SEQ ID NO: 39 - DNA, 21 bp, Artificial Sequence
  Description of Artificial Sequence: Synthetic oligonucleotide
  Description of Combined DNA/RNA Molecule: Synthetic oligonucleotide
ucuauuucccaguucgaggtt

SEQ ID NO: 40 - DNA, 21 bp, Artificial Sequence
  Description of Artificial Sequence: Synthetic oligonucleotide
  Description of Combined DNA/RNA Molecule: Synthetic oligonucleotide
cuauuucccaguucgaggctt

SEQ ID NO: 41 - DNA, 21 bp, Artificial Sequence
  Description of Artificial Sequence: Synthetic oligonucleotide
  Description of Combined DNA/RNA Molecule: Synthetic oligonucleotide
uauuucccaguucgaggcctt

SEQ ID NO: 42 - DNA, 21 bp, Artificial Sequence
  Description of Artificial Sequence: Synthetic oligonucleotide
  Description of Combined DNA/RNA Molecule: Synthetic oligonucleotide
auuucccaguucgaggccgtt

SEQ ID NO: 43 - DNA, 21 bp, Artificial Sequence
  Description of Artificial Sequence: Synthetic oligonucleotide
  Description of Combined DNA/RNA Molecule: Synthetic oligonucleotide
uuucccaguucgaggccgctt

SEQ ID NO: 44 - DNA, 21 bp, Artificial Sequence
  Description of Artificial Sequence: Synthetic oligonucleotide
  Description of Combined DNA/RNA Molecule: Synthetic oligonucleotide
uucccaguucgaggccgcutt

SEQ ID NO: 45 - DNA, 21 bp, Artificial Sequence
  Description of Artificial Sequence: Synthetic oligonucleotide
  Description of Combined DNA/RNA Molecule: Synthetic oligonucleotide
ucccaguucgaggccgcugtt

SEQ ID NO: 46 - DNA, 21 bp, Artificial Sequence
  Description of Artificial Sequence: Synthetic oligonucleotide
  Description of Combined DNA/RNA Molecule: Synthetic oligonucleotide
cccaguucgaggccgcugctt

SEQ ID NO: 47 - DNA, 21 bp, Artificial Sequence
  Description of Artificial Sequence: Synthetic oligonucleotide
  Description of Combined DNA/RNA Molecule: Synthetic oligonucleotide
ccaguucgaggccgcugcgtt

SEQ ID NO: 48 - DNA, 21 bp, Artificial Sequence
  Description of Artificial Sequence: Synthetic oligonucleotide
  Description of Combined DNA/RNA Molecule: Synthetic oligonucleotide
caguucgaggccgcugcgctt

SEQ ID NO: 49 - DNA, 21 bp, Artificial Sequence
  Description of Artificial Sequence: Synthetic oligonucleotide
  Description of Combined DNA/RNA Molecule: Synthetic oligonucleotide
aguucgaggccgcugcgcgtt

SEQ ID NO: 50 - DNA, 21 bp, Artificial Sequence
  Description of Artificial Sequence: Synthetic oligonucleotide
  Description of Combined DNA/RNA Molecule: Synthetic oligonucleotide
guucgaggccgcugcgcggtt

SEQ ID NO: 51 - DNA, 21 bp, Artificial Sequence
  Description of Artificial Sequence: Synthetic oligonucleotide
  Description of Combined DNA/RNA Molecule: Synthetic oligonucleotide
uucgaggccgcugcgcggctt

SEQ ID NO: 52 - DNA, 21 bp, Artificial Sequence
  Description of Artificial Sequence: Synthetic oligonucleotide
  Description of Combined DNA/RNA Molecule: Synthetic oligonucleotide
ucgaggccgcugcgcggcctt

SEQ ID NO: 53 - DNA, 21 bp, Artificial Sequence
  Description of Artificial Sequence: Synthetic oligonucleotide
  Description of Combined DNA/RNA Molecule: Synthetic oligonucleotide
cgaggccgcugcgcggccctt

SEQ ID NO: 54 - DNA, 21 bp, Artificial Sequence
  Description of Artificial Sequence: Synthetic oligonucleotide
  Description of Combined DNA/RNA Molecule: Synthetic oligonucleotide
gaggccgcugcgcggcccutt

SEQ ID NO: 55 - DNA, 21 bp, Artificial Sequence
  Description of Artificial Sequence: Synthetic oligonucleotide
  Description of Combined DNA/RNA Molecule: Synthetic oligonucleotide
aggccgcugcgcggcccugtt

SEQ ID NO: 56 - DNA, 21 bp, Artificial Sequence
  Description of Artificial Sequence: Synthetic oligonucleotide
  Description of Combined DNA/RNA Molecule: Synthetic oligonucleotide
ggccgcugcgcggcccugctt

SEQ ID NO: 57 - DNA, 21 bp, Artificial Sequence
  Description of Artificial Sequence: Synthetic oligonucleotide
  Description of Combined DNA/RNA Molecule: Synthetic oligonucleotide
gccgcugcgcggcccugcgtt

SEQ ID NO: 58 - DNA, 21 bp, Artificial Sequence
  Description of Artificial Sequence: Synthetic oligonucleotide
  Description of Combined DNA/RNA Molecule: Synthetic oligonucleotide
ccgcugcgcggcccugcgctt

SEQ ID NO: 59 - DNA, 21 bp, Artificial Sequence
  Description of Artificial Sequence: Synthetic oligonucleotide
  Description of Combined DNA/RNA Molecule: Synthetic oligonucleotide
cgcugcgcggcccugcgcatt

SEQ ID NO: 60 - DNA, 21 bp, Artificial Sequence
  Description of Artificial Sequence: Synthetic oligonucleotide
  Description of Combined DNA/RNA Molecule: Synthetic oligonucleotide
gcugcgcggcccugcgcautt

SEQ ID NO: 61 - DNA, 21 bp, Artificial Sequence
  Description of Artificial Sequence: Synthetic oligonucleotide
  Description of Combined DNA/RNA Molecule: Synthetic oligonucleotide
cugcgcggcccugcgcaugtt

SEQ ID NO: 62 - DNA, 21 bp, Artificial Sequence
  Description of Artificial Sequence: Synthetic oligonucleotide
  Description of Combined DNA/RNA Molecule: Synthetic oligonucleotide
ugcgcggcccugcgcaugctt

SEQ ID NO: 63 - DNA, 21 bp, Artificial Sequence
  Description of Artificial Sequence: Synthetic oligonucleotide
  Description of Combined DNA/RNA Molecule: Synthetic oligonucleotide
gcgcggcccugcgcaugcutt

SEQ ID NO: 64 - DNA, 21 bp, Artificial Sequence
  Description of Artificial Sequence: Synthetic oligonucleotide
  Description of Combined DNA/RNA Molecule: Synthetic oligonucleotide
cgcggcccugcgcaugcugtt

SEQ ID NO: 65 - DNA, 21 bp, Artificial Sequence
  Description of Artificial Sequence: Synthetic oligonucleotide
  Description of Combined DNA/RNA Molecule: Synthetic oligonucleotide
gcggcccugcgcaugcugctt

SEQ ID NO: 66 - DNA, 21 bp, Artificial Sequence
  Description of Artificial Sequence: Synthetic oligonucleotide
  Description of Combined DNA/RNA Molecule: Synthetic oligonucleotide
cggcccugcgcaugcugcutt

SEQ ID NO: 67 - DNA, 21 bp, Artificial Sequence
  Description of Artificial Sequence: Synthetic oligonucleotide
  Description of Combined DNA/RNA Molecule: Synthetic oligonucleotide
ggcccugcgcaugcugcugtt

SEQ ID NO: 68 - DNA, 21 bp, Artificial Sequence
  Description of Artificial Sequence: Synthetic oligonucleotide
  Description of Combined DNA/RNA Molecule: Synthetic oligonucleotide
gcccugcgcaugcugcuggtt

SEQ ID NO: 69 - DNA, 21 bp, Artificial Sequence
  Description of Artificial Sequence: Synthetic oligonucleotide
  Description of Combined DNA/RNA Molecule: Synthetic oligonucleotide
cccugcgcaugcugcuggctt

SEQ ID NO: 70 - DNA, 21 bp, Artificial Sequence
  Description of Artificial Sequence: Synthetic oligonucleotide
  Description of Combined DNA/RNA Molecule: Synthetic oligonucleotide
ccugcgcaugcugcuggcatt

SEQ ID NO: 71 - DNA, 21 bp, Artificial Sequence
  Description of Artificial Sequence: Synthetic oligonucleotide
  Description of Combined DNA/RNA Molecule: Synthetic oligonucleotide
cugcgcaugcugcuggcagtt

SEQ ID NO: 72 - DNA, 21 bp, Artificial Sequence
  Description of Artificial Sequence: Synthetic oligonucleotide
  Description of Combined DNA/RNA Molecule: Synthetic oligonucleotide
ugcgcaugcugcuggcagatt

SEQ ID NO: 73 - DNA, 21 bp, Artificial Sequence
  Description of Artificial Sequence: Synthetic oligonucleotide
  Description of Combined DNA/RNA Molecule: Synthetic oligonucleotide
gcgcaugcugcuggcagautt

SEQ ID NO: 74 - DNA, 21 bp, Artificial Sequence
  Description of Artificial Sequence: Synthetic oligonucleotide
  Description of Combined DNA/RNA Molecule: Synthetic oligonucleotide
cgcaugcugcuggcagauctt

SEQ ID NO: 75 - DNA, 21 bp, Artificial Sequence
  Description of Artificial Sequence: Synthetic oligonucleotide
  Description of Combined DNA/RNA Molecule: Synthetic oligonucleotide
gcaugcugcuggcagaucatt

SEQ ID NO: 76 - DNA, 21 bp, Artificial Sequence
  Description of Artificial Sequence: Synthetic oligonucleotide
  Description of Combined DNA/RNA Molecule: Synthetic oligonucleotide
caugcugcuggcagaucagtt

SEQ ID NO: 77 - DNA, 21 bp, Artificial Sequence
  Description of Artificial Sequence: Synthetic oligonucleotide
  Description of Combined DNA/RNA Molecule: Synthetic oligonucleotide
augcugcuggcagaucaggtt

SEQ ID NO: 78 - DNA, 21 bp, Artificial Sequence
  Description of Artificial Sequence: Synthetic oligonucleotide
  Description of Combined DNA/RNA Molecule: Synthetic oligonucleotide
ugcugcuggcagaucagggtt

SEQ ID NO: 79 - DNA, 21 bp, Artificial Sequence
  Description of Artificial Sequence: Synthetic oligonucleotide
  Description of Combined DNA/RNA Molecule: Synthetic oligonucleotide
gcugcuggcagaucagggctt

SEQ ID NO: 80 - DNA, 21 bp, Artificial Sequence
  Description of Artificial Sequence: Synthetic oligonucleotide
  Description of Combined DNA/RNA Molecule: Synthetic oligonucleotide
cugcuggcagaucagggcctt

SEQ ID NO: 81 - DNA, 21 bp, Artificial Sequence
  Description of Artificial Sequence: Synthetic oligonucleotide
  Description of Combined DNA/RNA Molecule: Synthetic oligonucleotide
ugcuggcagaucagggccatt

SEQ ID NO: 82 - DNA, 21 bp, Artificial Sequence
  Description of Artificial Sequence: Synthetic oligonucleotide
  Description of Combined DNA/RNA Molecule: Synthetic oligonucleotide
gcuggcagaucagggccagtt

SEQ ID NO: 83 - DNA, 21 bp, Artificial Sequence
  Description of Artificial Sequence: Synthetic oligonucleotide
  Description of Combined DNA/RNA Molecule: Synthetic oligonucleotide
cuggcagaucagggccagatt

SEQ ID NO: 84 - DNA, 21 bp, Artificial Sequence
  Description of Artificial Sequence: Synthetic oligonucleotide
  Description of Combined DNA/RNA Molecule: Synthetic oligonucleotide
uggcagaucagggccagagtt

SEQ ID NO: 85 - DNA, 21 bp, Artificial Sequence
  Description of Artificial Sequence: Synthetic oligonucleotide
  Description of Combined DNA/RNA Molecule: Synthetic oligonucleotide
ggcagaucagggccagagctt

SEQ ID NO: 86 - DNA, 21 bp, Artificial Sequence
  Description of Artificial Sequence: Synthetic oligonucleotide
  Description of Combined DNA/RNA Molecule: Synthetic oligonucleotide
gcagaucagggccagagcutt

SEQ ID NO: 87 - DNA, 21 bp, Artificial Sequence
  Description of Artificial Sequence: Synthetic oligonucleotide
  Description of Combined DNA/RNA Molecule: Synthetic oligonucleotide
cagaucagggccagagcugtt

SEQ ID NO: 88 - DNA, 21 bp, Artificial Sequence
  Description of Artificial Sequence: Synthetic oligonucleotide
  Description of Combined DNA/RNA Molecule: Synthetic oligonucleotide
agaucagggccagagcuggtt

SEQ ID NO: 89 - DNA, 21 bp, Artificial Sequence
  Description of Artificial Sequence: Synthetic oligonucleotide
  Description of Combined DNA/RNA Molecule: Synthetic oligonucleotide
gaucagggccagagcuggatt

SEQ ID NO: 90 - DNA, 21 bp, Artificial Sequence
  Description of Artificial Sequence: Synthetic oligonucleotide
  Description of Combined DNA/RNA Molecule: Synthetic oligonucleotide
aucagggccagagcuggaatt

SEQ ID NO: 91 - DNA, 21 bp, Artificial Sequence
  Description of Artificial Sequence: Synthetic oligonucleotide
  Description of Combined DNA/RNA Molecule: Synthetic oligonucleotide
ucagggccagagcuggaagtt

SEQ ID NO: 92 - DNA, 21 bp, Artificial Sequence
  Description of Artificial Sequence: Synthetic oligonucleotide
  Description of Combined DNA/RNA Molecule: Synthetic oligonucleotide
cagggccagagcuggaaggtt

SEQ ID NO: 93 - DNA, 21 bp, Artificial Sequence
  Description of Artificial Sequence: Synthetic oligonucleotide
  Description of Combined DNA/RNA Molecule: Synthetic oligonucleotide
agggccagagcuggaaggatt

SEQ ID NO: 94 - DNA, 21 bp, Artificial Sequence
  Description of Artificial Sequence: Synthetic oligonucleotide
  Description of Combined DNA/RNA Molecule: Synthetic oligonucleotide
gggccagagcuggaaggagtt

SEQ ID NO: 95 - DNA, 21 bp, Artificial Sequence
  Description of Artificial Sequence: Synthetic oligonucleotide
  Description of Combined DNA/RNA Molecule: Synthetic oligonucleotide
ggccagagcuggaaggaggtt

SEQ ID NO: 96 - DNA, 21 bp, Artificial Sequence
  Description of Artificial Sequence: Synthetic oligonucleotide
  Description of Combined DNA/RNA Molecule: Synthetic oligonucleotide
gccagagcuggaaggaggatt

SEQ ID NO: 97 - DNA, 21 bp, Artificial Sequence
  Description of Artificial Sequence: Synthetic oligonucleotide
  Description of Combined DNA/RNA Molecule: Synthetic oligonucleotide
ccagagcuggaaggaggagtt

SEQ ID NO: 98 - DNA, 21 bp, Artificial Sequence
  Description of Artificial Sequence: Synthetic oligonucleotide
  Description of Combined DNA/RNA Molecule: Synthetic oligonucleotide
cagagcuggaaggaggaggtt

SEQ ID NO: 99 - DNA, 21 bp, Artificial Sequence
  Description of Artificial Sequence: Synthetic oligonucleotide
  Description of Combined DNA/RNA Molecule: Synthetic oligonucleotide
agagcuggaaggaggaggutt

SEQ ID NO: 100 - DNA, 21 bp, Artificial Sequence
  Description of Artificial Sequence: Synthetic oligonucleotide
  Description of Combined DNA/RNA Molecule: Synthetic oligonucleotide
gagcuggaaggaggaggugtt

SEQ ID NO: 101 - DNA, 21 bp, Artificial Sequence
  Description of Artificial Sequence: Synthetic oligonucleotide
  Description of Combined DNA/RNA Molecule: Synthetic oligonucleotide
gagcuggaaggaggagguatt

SEQ ID NO: 102 - DNA, 21 bp, Artificial Sequence
  Description of Artificial Sequence: Synthetic oligonucleotide
  Description of Combined DNA/RNA Molecule: Synthetic oligonucleotide
agcuggaaggaggagguggtt

SEQ ID NO: 103 - DNA, 21 bp, Artificial Sequence
  Description of Artificial Sequence: Synthetic oligonucleotide
  Description of Combined DNA/RNA Molecule: Synthetic oligonucleotide
gcuggaaggaggagguggutt

SEQ ID NO: 104 - DNA, 21 bp, Artificial Sequence
  Description of Artificial Sequence: Synthetic oligonucleotide
  Description of Combined DNA/RNA Molecule: Synthetic oligonucleotide
cuggaaggaggagguggugtt

SEQ ID NO: 105 - DNA, 21 bp, Artificial Sequence
  Description of Artificial Sequence: Synthetic oligonucleotide
  Description of Combined DNA/RNA Molecule: Synthetic oligonucleotide
uggaaggaggagguggugatt

SEQ ID NO: 106 - DNA, 21 bp, Artificial Sequence
  Description of Artificial Sequence: Synthetic oligonucleotide
  Description of Combined DNA/RNA Molecule: Synthetic oligonucleotide
ggaaggaggagguggugactt

SEQ ID NO: 107 - DNA, 21 bp, Artificial Sequence
  Description of Artificial Sequence: Synthetic oligonucleotide
  Description of Combined DNA/RNA Molecule: Synthetic oligonucleotide
gaaggaggagguggugacctt

SEQ ID NO: 108 - DNA, 21 bp, Artificial Sequence
  Description of Artificial Sequence: Synthetic oligonucleotide
  Description of Combined DNA/RNA Molecule: Synthetic oligonucleotide
aaggaggagguggugaccgtt

SEQ ID NO: 109 - DNA, 21 bp, Artificial Sequence
  Description of Artificial Sequence: Synthetic oligonucleotide
  Description of Combined DNA/RNA Molecule: Synthetic oligonucleotide
aggaggagguggugaccgutt

SEQ ID NO: 110 - DNA, 21 bp, Artificial Sequence
  Description of Artificial Sequence: Synthetic oligonucleotide
  Description of Combined DNA/RNA Molecule: Synthetic oligonucleotide
ggaggagguggugaccgugtt

SEQ ID NO: 111 - DNA, 21 bp, Artificial Sequence
  Description of Artificial Sequence: Synthetic oligonucleotide
  Description of Combined DNA/RNA Molecule: Synthetic oligonucleotide
gaggagguggugaccguggtt

SEQ ID NO: 112 - DNA, 21 bp, Artificial Sequence
  Description of Artificial Sequence: Synthetic oligonucleotide
  Description of Combined DNA/RNA Molecule: Synthetic oligonucleotide
aggagguggugaccguggatt

SEQ ID NO: 113 - DNA, 21 bp, Artificial Sequence
  Description of Artificial Sequence: Synthetic oligonucleotide
  Description of Combined DNA/RNA Molecule: Synthetic oligonucleotide
ggagguggugaccguggagtt

SEQ ID NO: 114 - DNA, 21 bp, Artificial Sequence
  Description of Artificial Sequence: Synthetic oligonucleotide
  Description of Combined DNA/RNA Molecule: Synthetic oligonucleotide
gagguggugaccguggagatt

SEQ ID NO: 115 - DNA, 21 bp, Artificial Sequence
  Description of Artificial Sequence: Synthetic oligonucleotide
  Description of Combined DNA/RNA Molecule: Synthetic oligonucleotide
agguggugaccguggagactt

SEQ ID NO: 116 - DNA, 21 bp, Artificial Sequence
  Description of Artificial Sequence: Synthetic oligonucleotide
  Description of Combined DNA/RNA Molecule: Synthetic oligonucleotide
gguggugaccguggagacgtt

SEQ ID NO: 117 - DNA, 21 bp, Artificial Sequence
  Description of Artificial Sequence: Synthetic oligonucleotide
  Description of Combined DNA/RNA Molecule: Synthetic oligonucleotide
guggugaccguggagacgutt

SEQ ID NO: 118 - DNA, 21 bp, Artificial Sequence
  Description of Artificial Sequence: Synthetic oligonucleotide
  Description of Combined DNA/RNA Molecule: Synthetic oligonucleotide
uggugaccguggagacgugtt

SEQ ID NO: 119 - DNA, 21 bp, Artificial Sequence
  Description of Artificial Sequence: Synthetic oligonucleotide
  Description of Combined DNA/RNA Molecule: Synthetic oligonucleotide
ggugaccguggagacguggtt

SEQ ID NO: 120 - DNA, 21 bp, Artificial Sequence
  Description of Artificial Sequence: Synthetic oligonucleotide
  Description of Combined DNA/RNA Molecule: Synthetic oligonucleotide
gugaccguggagacguggctt

SEQ ID NO: 121 - DNA, 21 bp, Artificial Sequence
  Description of Artificial Sequence: Synthetic oligonucleotide
  Description of Combined DNA/RNA Molecule: Synthetic oligonucleotide
ugaccguggagacguggcatt

SEQ ID NO: 122 - DNA, 21 bp, Artificial Sequence
  Description of Artificial Sequence: Synthetic oligonucleotide
  Description of Combined DNA/RNA Molecule: Synthetic oligonucleotide
gaccguggagacguggcagtt

SEQ ID NO: 123 - DNA, 21 bp, Artificial Sequence
  Description of Artificial Sequence: Synthetic oligonucleotide
  Description of Combined DNA/RNA Molecule: Synthetic oligonucleotide
accguggagacguggcaggtt

SEQ ID NO: 124 - DNA, 21 bp, Artificial Sequence
  Description of Artificial Sequence: Synthetic oligonucleotide
  Description of Combined DNA/RNA Molecule: Synthetic oligonucleotide
ccguggagacguggcaggatt

SEQ ID NO: 125 - DNA, 21 bp, Artificial Sequence
  Description of Artificial Sequence: Synthetic oligonucleotide
  Description of Combined DNA/RNA Molecule: Synthetic oligonucleotide
cguggagacguggcaggagtt

SEQ ID NO: 126 - DNA, 21 bp, Artificial Sequence
  Description of Artificial Sequence: Synthetic oligonucleotide
  Description of Combined DNA/RNA Molecule: Synthetic oligonucleotide
guggagacguggcaggaggtt

SEQ ID NO: 127 - DNA, 21 bp, Artificial Sequence
  Description of Artificial Sequence: Synthetic oligonucleotide
  Description of Combined DNA/RNA Molecule: Synthetic oligonucleotide
uggagacguggcaggagggtt

SEQ ID NO: 128 - DNA, 21 bp, Artificial Sequence
  Description of Artificial Sequence: Synthetic oligonucleotide
  Description of Combined DNA/RNA Molecule: Synthetic oligonucleotide
ggagacguggcaggagggctt

SEQ ID NO: 129 - DNA, 21 bp, Artificial Sequence
  Description of Artificial Sequence: Synthetic oligonucleotide
  Description of Combined DNA/RNA Molecule: Synthetic oligonucleotide
gagacguggcaggagggcutt

SEQ ID NO: 130 - DNA, 21 bp, Artificial Sequence
  Description of Artificial Sequence: Synthetic oligonucleotide
  Description of Combined DNA/RNA Molecule: Synthetic oligonucleotide
agacguggcaggagggcuctt

SEQ ID NO: 131 - DNA, 21 bp, Artificial Sequence
  Description of Artificial Sequence: Synthetic oligonucleotide
  Description of Combined DNA/RNA Molecule: Synthetic oligonucleotide
gacguggcaggagggcucatt

SEQ ID NO: 132 - DNA, 21 bp, Artificial Sequence
  Description of Artificial Sequence: Synthetic oligonucleotide
  Description of Combined DNA/RNA Molecule: Synthetic oligonucleotide
acguggcaggagggcucactt

SEQ ID NO: 133 - DNA, 21 bp, Artificial Sequence
  Description of Artificial Sequence: Synthetic oligonucleotide
  Description of Combined DNA/RNA Molecule: Synthetic oligonucleotide
cguggcaggagggcucacutt

SEQ ID NO: 134 - DNA, 21 bp, Artificial Sequence
  Description of Artificial Sequence: Synthetic oligonucleotide
  Description of Combined DNA/RNA Molecule: Synthetic oligonucleotide
guggcaggagggcucacuctt

SEQ ID NO: 135 - DNA, 21 bp, Artificial Sequence
  Description of Artificial Sequence: Synthetic oligonucleotide
  Description of Combined DNA/RNA Molecule: Synthetic oligonucleotide
uggcaggagggcucacucatt

SEQ ID NO: 136 - DNA, 21 bp, Artificial Sequence
  Description of Artificial Sequence: Synthetic oligonucleotide
  Description of Combined DNA/RNA Molecule: Synthetic oligonucleotide
ggcaggagggcucacucaatt

SEQ ID NO: 137 - DNA, 21 bp, Artificial Sequence
  Description of Artificial Sequence: Synthetic oligonucleotide
  Description of Combined DNA/RNA Molecule: Synthetic oligonucleotide
gcaggagggcucacucaaatt

SEQ ID NO: 138 - DNA, 21 bp, Artificial Sequence
  Description of Artificial Sequence: Synthetic oligonucleotide
  Description of Combined DNA/RNA Molecule: Synthetic oligonucleotide
caggagggcucacucaaagtt

SEQ ID NO: 139 - DNA, 21 bp, Artificial Sequence
  Description of Artificial Sequence: Synthetic oligonucleotide
  Description of Combined DNA/RNA Molecule: Synthetic oligonucleotide
aggagggcucacucaaagctt

SEQ ID NO: 140 - DNA, 21 bp, Artificial Sequence
  Description of Artificial Sequence: Synthetic oligonucleotide
  Description of Combined DNA/RNA Molecule: Synthetic oligonucleotide
ggagggcucacucaaagcctt

SEQ ID NO: 141 - DNA, 21 bp, Artificial Sequence
  Description of Artificial Sequence: Synthetic oligonucleotide
  Description of Combined DNA/RNA Molecule: Synthetic oligonucleotide
gagggcucacucaaagccutt

SEQ ID NO: 142 - DNA, 21 bp, Artificial Sequence
  Description of Artificial Sequence: Synthetic oligonucleotide
  Description of Combined DNA/RNA Molecule: Synthetic oligonucleotide
agggcucacucaaagccuctt

SEQ ID NO: 143 - DNA, 21 bp, Artificial Sequence
  Description of Artificial Sequence: Synthetic oligonucleotide
  Description of Combined DNA/RNA Molecule: Synthetic oligonucleotide
gggcucacucaaagccucctt

SEQ ID NO: 144 - DNA, 21 bp, Artificial Sequence
  Description of Artificial Sequence: Synthetic oligonucleotide
  Description of Combined DNA/RNA Molecule: Synthetic oligonucleotide
ggcucacucaaagccuccutt

SEQ ID NO: 145 - DNA, 21 bp, Artificial Sequence
  Description of Artificial Sequence: Synthetic oligonucleotide
  Description of Combined DNA/RNA Molecule: Synthetic oligonucleotide
gcucacucaaagccuccugtt

SEQ ID NO: 146 - DNA, 21 bp, Artificial Sequence
  Description of Artificial Sequence: Synthetic oligonucleotide
  Description of Combined DNA/RNA Molecule: Synthetic oligonucleotide
cucacucaaagccuccugctt

SEQ ID NO: 147 - DNA, 21 bp, Artificial Sequence
  Description of Artificial Sequence: Synthetic oligonucleotide
  Description of Combined DNA/RNA Molecule: Synthetic oligonucleotide
ucacucaaagccuccugcctt

SEQ ID NO: 148 - DNA, 21 bp, Artificial Sequence
  Description of Artificial Sequence: Synthetic oligonucleotide
  Description of Combined DNA/RNA Molecule: Synthetic oligonucleotide
cacucaaagccuccugccutt

SEQ ID NO: 149 - DNA, 21 bp, Artificial Sequence
  Description of Artificial Sequence: Synthetic oligonucleotide
  Description of Combined DNA/RNA Molecule: Synthetic oligonucleotide
acucaaagccuccugccuatt

SEQ ID NO: 150 - DNA, 21 bp, Artificial Sequence
  Description of Artificial Sequence: Synthetic oligonucleotide
  Description of Combined DNA/RNA Molecule: Synthetic oligonucleotide
cucaaagccuccugccuautt

SEQ ID NO: 151 - DNA, 21 bp, Artificial Sequence
  Description of Artificial Sequence: Synthetic oligonucleotide
  Description of Combined DNA/RNA Molecule: Synthetic oligonucleotide
ucaaagccuccugccuauatt

SEQ ID NO: 152 - DNA, 21 bp, Artificial Sequence
  Description of Artificial Sequence: Synthetic oligonucleotide
  Description of Combined DNA/RNA Molecule: Synthetic oligonucleotide
caaagccuccugccuauactt

SEQ ID NO: 153 - DNA, 21 bp, Artificial Sequence
  Description of Artificial Sequence: Synthetic oligonucleotide
  Description of Combined DNA/RNA Molecule: Synthetic oligonucleotide
aaagccuccugccuauacgtt

SEQ ID NO: 154 - DNA, 21 bp, Artificial Sequence
  Description of Artificial Sequence: Synthetic oligonucleotide
  Description of Combined DNA/RNA Molecule: Synthetic oligonucleotide
aagccuccugccuauacggtt

SEQ ID NO: 155 - DNA, 21 bp, Artificial Sequence
  Description of Artificial Sequence: Synthetic oligonucleotide
  Description of Combined DNA/RNA Molecule: Synthetic oligonucleotide
agccuccugccuauacgggtt

SEQ ID NO: 156 - DNA, 21 bp, Artificial Sequence
  Description of Artificial Sequence: Synthetic oligonucleotide
  Description of Combined DNA/RNA Molecule: Synthetic oligonucleotide
gccuccugccuauacgggctt

SEQ ID NO: 157 - DNA, 21 bp, Artificial Sequence
  Description of Artificial Sequence: Synthetic oligonucleotide
  Description of Combined DNA/RNA Molecule: Synthetic oligonucleotide
ccuccugccuauacgggcatt

SEQ ID NO: 158 - DNA, 21 bp, Artificial Sequence
  Description of Artificial Sequence: Synthetic oligonucleotide
  Description of Combined DNA/RNA Molecule: Synthetic oligonucleotide
cuccugccuauacgggcagtt

SEQ ID NO: 159 - DNA, 21 bp, Artificial Sequence
  Description of Artificial Sequence: Synthetic oligonucleotide
  Description of Combined DNA/RNA Molecule: Synthetic oligonucleotide
uccugccuauacgggcagctt

SEQ ID NO: 160 - DNA, 21 bp, Artificial Sequence
  Description of Artificial Sequence: Synthetic oligonucleotide
  Description of Combined DNA/RNA Molecule: Synthetic oligonucleotide
ccugccuauacgggcagcutt

SEQ ID NO: 161 - DNA, 21 bp, Artificial Sequence
  Description of Artificial Sequence: Synthetic oligonucleotide
  Description of Combined DNA/RNA Molecule: Synthetic oligonucleotide
cugccuauacgggcagcuctt

SEQ ID NO: 162 - DNA, 21 bp, Artificial Sequence
  Description of Artificial Sequence: Synthetic oligonucleotide
  Description of Combined DNA/RNA Molecule: Synthetic oligonucleotide
ugccuauacgggcagcucctt

SEQ ID NO: 163 - DNA, 21 bp, Artificial Sequence
  Description of Artificial Sequence: Synthetic oligonucleotide
  Description of Combined DNA/RNA Molecule: Synthetic oligonucleotide
gccuauacgggcagcuccctt

SEQ ID NO: 164 - DNA, 21 bp, Artificial Sequence
  Description of Artificial Sequence: Synthetic oligonucleotide
  Description of Combined DNA/RNA Molecule: Synthetic oligonucleotide
cccaaguuccaggacggagtt

SEQ ID NO: 165 - DNA, 21 bp, Artificial Sequence
  Description of Artificial Sequence: Synthetic oligonucleotide
  Description of Combined DNA/RNA Molecule: Synthetic oligonucleotide
ccaaguuccaggacggagatt

SEQ ID NO: 166 - DNA, 21 bp, Artificial Sequence
  Description of Artificial Sequence: Synthetic oligonucleotide
  Description of Combined DNA/RNA Molecule: Synthetic oligonucleotide
caaguuccaggacggagactt

SEQ ID NO: 167 - DNA, 21 bp, Artificial Sequence
  Description of Artificial Sequence: Synthetic oligonucleotide
  Description of Combined DNA/RNA Molecule: Synthetic oligonucleotide
aaguuccaggacggagacctt

SEQ ID NO: 168 - DNA, 21 bp, Artificial Sequence
  Description of Artificial Sequence: Synthetic oligonucleotide
  Description of Combined DNA/RNA Molecule: Synthetic oligonucleotide
aguuccaggacggagaccutt

SEQ ID NO: 169 - DNA, 21 bp, Artificial Sequence
  Description of Artificial Sequence: Synthetic oligonucleotide
  Description of Combined DNA/RNA Molecule: Synthetic oligonucleotide
guuccaggacggagaccuctt

SEQ ID NO: 170 - DNA, 21 bp, Artificial Sequence
  Description of Artificial Sequence: Synthetic oligonucleotide
  Description of Combined DNA/RNA Molecule: Synthetic oligonucleotide
uuccaggacggagaccucatt

SEQ ID NO: 171 - DNA, 21 bp, Artificial Sequence
  Description of Artificial Sequence: Synthetic oligonucleotide
  Description of Combined DNA/RNA Molecule: Synthetic oligonucleotide
uccaggacggagaccucactt

SEQ ID NO: 172 - DNA, 21 bp, Artificial Sequence
  Description of Artificial Sequence: Synthetic oligonucleotide
  Description of Combined DNA/RNA Molecule: Synthetic oligonucleotide
ccaggacggagaccucacctt

SEQ ID NO: 173 - DNA, 21 bp, Artificial Sequence
  Description of Artificial Sequence: Synthetic oligonucleotide
  Description of Combined DNA/RNA Molecule: Synthetic oligonucleotide
caggacggagaccucaccctt

SEQ ID NO: 174 - DNA, 21 bp, Artificial Sequence
  Description of Artificial Sequence: Synthetic oligonucleotide
  Description of Combined DNA/RNA Molecule: Synthetic oligonucleotide
aggacggagaccucacccutt

SEQ ID NO: 175 - DNA, 21 bp, Artificial Sequence
  Description of Artificial Sequence: Synthetic oligonucleotide
  Description of Combined DNA/RNA Molecule: Synthetic oligonucleotide
ggacggagaccucacccugtt

SEQ ID NO: 176 - DNA, 21 bp, Artificial Sequence
  Description of Artificial Sequence: Synthetic oligonucleotide
  Description of Combined DNA/RNA Molecule: Synthetic oligonucleotide
gacggagaccucacccugutt

SEQ ID NO: 177 - DNA, 21 bp, Artificial Sequence
  Description of Artificial Sequence: Synthetic oligonucleotide
  Description of Combined DNA/RNA Molecule: Synthetic oligonucleotide
acggagaccucacccuguatt

SEQ ID NO: 178 - DNA, 21 bp, Artificial Sequence
  Description of Artificial Sequence: Synthetic oligonucleotide
  Description of Combined DNA/RNA Molecule: Synthetic oligonucleotide
cggagaccucacccuguactt

SEQ ID NO: 179 - DNA, 21 bp, Artificial Sequence
  Description of Artificial Sequence: Synthetic oligonucleotide
  Description of Combined DNA/RNA Molecule: Synthetic oligonucleotide
ggagaccucacccuguacctt

SEQ ID NO: 180 - DNA, 21 bp, Artificial Sequence
  Description of Artificial Sequence: Synthetic oligonucleotide
  Description of Combined DNA/RNA Molecule: Synthetic oligonucleotide
gagaccucacccuguaccatt

SEQ ID NO: 181 - DNA, 21 bp, Artificial Sequence
  Description of Artificial Sequence: Synthetic oligonucleotide
  Description of Combined DNA/RNA Molecule: Synthetic oligonucleotide
agaccucacccuguaccagtt

SEQ ID NO: 182 - DNA, 21 bp, Artificial Sequence
  Description of Artificial Sequence: Synthetic oligonucleotide
  Description of Combined DNA/RNA Molecule: Synthetic oligonucleotide
gaccucacccuguaccagutt

SEQ ID NO: 183 - DNA, 21 bp, Artificial Sequence
  Description of Artificial Sequence: Synthetic oligonucleotide
  Description of Combined DNA/RNA Molecule: Synthetic oligonucleotide
accucacccuguaccaguctt

SEQ ID NO: 184 - DNA, 21 bp, Artificial Sequence
  Description of Artificial Sequence: Synthetic oligonucleotide
  Description of Combined DNA/RNA Molecule: Synthetic oligonucleotide
ccucacccuguaccagucctt

SEQ ID NO: 185 - DNA, 21 bp, Artificial Sequence
  Description of Artificial Sequence: Synthetic oligonucleotide
  Description of Combined DNA/RNA Molecule: Synthetic oligonucleotide
cucacccuguaccaguccatt

SEQ ID NO: 186 - DNA, 21 bp, Artificial Sequence
  Description of Artificial Sequence: Synthetic oligonucleotide
  Description of Combined DNA/RNA Molecule: Synthetic oligonucleotide
ucacccuguaccaguccaatt

SEQ ID NO: 187 - DNA, 21 bp, Artificial Sequence
  Description of Artificial Sequence: Synthetic oligonucleotide
  Description of Combined DNA/RNA Molecule: Synthetic oligonucleotide
cacccuguaccaguccaautt

SEQ ID NO: 188 - DNA, 21 bp, Artificial Sequence
  Description of Artificial Sequence: Synthetic oligonucleotide
  Description of Combined DNA/RNA Molecule: Synthetic oligonucleotide
acccuguaccaguccaauatt

SEQ ID NO: 189 - DNA, 21 bp, Artificial Sequence
  Description of Artificial Sequence: Synthetic oligonucleotide
  Description of Combined DNA/RNA Molecule: Synthetic oligonucleotide
cccuguaccaguccaauactt

SEQ ID NO: 190 - DNA, 21 bp, Artificial Sequence
  Description of Artificial Sequence: Synthetic oligonucleotide
  Description of Combined DNA/RNA Molecule: Synthetic oligonucleotide
ccuguaccaguccaauacctt

SEQ ID NO: 191 - DNA, 21 bp, Artificial Sequence
  Description of Artificial Sequence: Synthetic oligonucleotide
  Description of Combined DNA/RNA Molecule: Synthetic oligonucleotide
cuguaccaguccaauaccatt

SEQ ID NO: 192 - DNA, 21 bp, Artificial Sequence
  Description of Artificial Sequence: Synthetic oligonucleotide
  Description of Combined DNA/RNA Molecule: Synthetic oligonucleotide
uguaccaguccaauaccautt

SEQ ID NO: 193 - DNA, 21 bp, Artificial Sequence
  Description of Artificial Sequence: Synthetic oligonucleotide
  Description of Combined DNA/RNA Molecule: Synthetic oligonucleotide
guaccaguccaauaccauctt

SEQ ID NO: 194 - DNA, 21 bp, Artificial Sequence
  Description of Artificial Sequence: Synthetic oligonucleotide
  Description of Combined DNA/RNA Molecule: Synthetic oligonucleotide
uaccaguccaauaccaucctt

SEQ ID NO: 195 - DNA, 21 bp, Artificial Sequence
  Description of Artificial Sequence: Synthetic oligonucleotide
  Description of Combined DNA/RNA Molecule: Synthetic oligonucleotide
accaguccaauaccauccutt

SEQ ID NO: 196 - DNA, 21 bp, Artificial Sequence
  Description of Artificial Sequence: Synthetic oligonucleotide
  Description of Combined DNA/RNA Molecule: Synthetic oligonucleotide
ccaguccaauaccauccugtt

SEQ ID NO: 197 - DNA, 21 bp, Artificial Sequence
  Description of Artificial Sequence: Synthetic oligonucleotide
  Description of Combined DNA/RNA Molecule: Synthetic oligonucleotide
caguccaauaccauccugctt

SEQ ID NO: 198 - DNA, 21 bp, Artificial Sequence
  Description of Artificial Sequence: Synthetic oligonucleotide
  Description of Combined DNA/RNA Molecule: Synthetic oligonucleotide
aguccaauaccauccugcgtt

SEQ ID NO: 199 - DNA, 21 bp, Artificial Sequence
  Description of Artificial Sequence: Synthetic oligonucleotide
  Description of Combined DNA/RNA Molecule: Synthetic oligonucleotide
guccaauaccauccugcgutt

SEQ ID NO: 200 - DNA, 21 bp, Artificial Sequence
  Description of Artificial Sequence: Synthetic oligonucleotide
  Description of Combined DNA/RNA Molecule: Synthetic oligonucleotide
uccaauaccauccugcguctt

SEQ ID NO: 201 - DNA, 21 bp, Artificial Sequence
  Description of Artificial Sequence: Synthetic oligonucleotide
  Description of Combined DNA/RNA Molecule: Synthetic oligonucleotide
ccaauaccauccugcgucatt

SEQ ID NO: 202 - DNA, 21 bp, Artificial Sequence
  Description of Artificial Sequence: Synthetic oligonucleotide
  Description of Combined DNA/RNA Molecule: Synthetic oligonucleotide
caauaccauccugcgucactt

SEQ ID NO: 203 - DNA, 21 bp, Artificial Sequence
  Description of Artificial Sequence: Synthetic oligonucleotide
  Description of Combined DNA/RNA Molecule: Synthetic oligonucleotide
aauaccauccugcgucacctt

SEQ ID NO: 204 - DNA, 21 bp, Artificial Sequence
  Description of Artificial Sequence: Synthetic oligonucleotide
  Description of Combined DNA/RNA Molecule: Synthetic oligonucleotide
auaccauccugcgucaccutt

SEQ ID NO: 205 - DNA, 21 bp, Artificial Sequence
  Description of Artificial Sequence: Synthetic oligonucleotide
  Description of Combined DNA/RNA Molecule: Synthetic oligonucleotide
uaccauccugcgucaccugtt

SEQ ID NO: 206 - DNA, 21 bp, Artificial Sequence
  Description of Artificial Sequence: Synthetic oligonucleotide
  Description of Combined DNA/RNA Molecule: Synthetic oligonucleotide
accauccugcgucaccuggtt

SEQ ID NO: 207 - DNA, 21 bp, Artificial Sequence
  Description of Artificial Sequence: Synthetic oligonucleotide
  Description of Combined DNA/RNA Molecule: Synthetic oligonucleotide
ccauccugcgucaccugggtt

SEQ ID NO: 208 - DNA, 21 bp, Artificial Sequence
  Description of Artificial Sequence: Synthetic oligonucleotide
  Description of Combined DNA/RNA Molecule: Synthetic oligonucleotide
cauccugcgucaccugggctt

SEQ ID NO: 209 - DNA, 21 bp, Artificial Sequence
  Description of Artificial Sequence: Synthetic oligonucleotide
  Description of Combined DNA/RNA Molecule: Synthetic oligonucleotide
auccugcgucaccugggcctt

SEQ ID NO: 210 - DNA, 21 bp, Artificial Sequence
  Description of Artificial Sequence: Synthetic oligonucleotide
  Description of Combined DNA/RNA Molecule: Synthetic oligonucleotide
uccugcgucaccugggccgtt

SEQ ID NO: 211 - DNA, 21 bp, Artificial Sequence
  Description of Artificial Sequence: Synthetic oligonucleotide
  Description of Combined DNA/RNA Molecule: Synthetic oligonucleotide
ccugcgucaccugggccgctt

SEQ ID NO: 212 - DNA, 21 bp, Artificial Sequence
  Description of Artificial Sequence: Synthetic oligonucleotide
  Description of Combined DNA/RNA Molecule: Synthetic oligonucleotide
cugcgucaccugggccgcatt

SEQ ID NO: 213 - DNA, 21 bp, Artificial Sequence
  Description of Artificial Sequence: Synthetic oligonucleotide
  Description of Combined DNA/RNA Molecule: Synthetic oligonucleotide
ugcgucaccugggccgcactt

SEQ ID NO: 214 - DNA, 21 bp, Artificial Sequence
  Description of Artificial Sequence: Synthetic oligonucleotide
  Description of Combined DNA/RNA Molecule: Synthetic oligonucleotide
gcgucaccugggccgcacctt

SEQ ID NO: 215 - DNA, 21 bp, Artificial Sequence
  Description of Artificial Sequence: Synthetic oligonucleotide
  Description of Combined DNA/RNA Molecule: Synthetic oligonucleotide
cgucaccugggccgcaccctt

SEQ ID NO: 216 - DNA, 21 bp, Artificial Sequence
  Description of Artificial Sequence: Synthetic oligonucleotide
  Description of Combined DNA/RNA Molecule: Synthetic oligonucleotide
gucaccugggccgcacccutt

SEQ ID NO: 217 - DNA, 21 bp, Artificial Sequence
  Description of Artificial Sequence: Synthetic oligonucleotide
  Description of Combined DNA/RNA Molecule: Synthetic oligonucleotide
ucaccugggccgcacccuutt

SEQ ID NO: 218 - DNA, 21 bp, Artificial Sequence
  Description of Artificial Sequence: Synthetic oligonucleotide
  Description of Combined DNA/RNA Molecule: Synthetic oligonucleotide
caccugggccgcacccuugtt

SEQ ID NO: 219 - DNA, 21 bp, Artificial Sequence
  Description of Artificial Sequence: Synthetic oligonucleotide
  Description of Combined DNA/RNA Molecule: Synthetic oligonucleotide
accugggccgcacccuuggtt

SEQ ID NO: 220 - DNA, 21 bp, Artificial Sequence
  Description of Artificial Sequence: Synthetic oligonucleotide
  Description of Combined DNA/RNA Molecule: Synthetic oligonucleotide
ccugggccgcacccuugggtt

SEQ ID NO: 221 - DNA, 21 bp, Artificial Sequence
  Description of Artificial Sequence: Synthetic oligonucleotide
  Description of Combined DNA/RNA Molecule: Synthetic oligonucleotide
cugggccgcacccuugggctt

SEQ ID NO: 222 - DNA, 21 bp, Artificial Sequence
  Description of Artificial Sequence: Synthetic oligonucleotide
  Description of Combined DNA/RNA Molecule: Synthetic oligonucleotide
ugggccgcacccuugggcutt

SEQ ID NO: 223 - DNA, 21 bp, Artificial Sequence
  Description of Artificial Sequence: Synthetic oligonucleotide
  Description of Combined DNA/RNA Molecule: Synthetic oligonucleotide
gggccgcacccuugggcuctt

SEQ ID NO: 224 - DNA, 21 bp, Artificial Sequence
  Description of Artificial Sequence: Synthetic oligonucleotide
  Description of Combined DNA/RNA Molecule: Synthetic oligonucleotide
ggccgcacccuugggcucutt

SEQ ID NO: 225 - DNA, 21 bp, Artificial Sequence
  Description of Artificial Sequence: Synthetic oligonucleotide
  Description of Combined DNA/RNA Molecule: Synthetic oligonucleotide
gccgcacccuugggcucuatt

SEQ ID NO: 226 - DNA, 21 bp, Artificial Sequence
  Description of Artificial Sequence: Synthetic oligonucleotide
  Description of Combined DNA/RNA Molecule: Synthetic oligonucleotide
ccgcacccuugggcucuautt

SEQ ID NO: 227 - DNA, 21 bp, Artificial Sequence
  Description of Artificial Sequence: Synthetic oligonucleotide
  Description of Combined DNA/RNA Molecule: Synthetic oligonucleotide
cgcacccuugggcucuaugtt

SEQ ID NO: 228 - DNA, 21 bp, Artificial Sequence
  Description of Artificial Sequence: Synthetic oligonucleotide
  Description of Combined DNA/RNA Molecule: Synthetic oligonucleotide
gcacccuugggcucuauggtt

SEQ ID NO: 229 - DNA, 21 bp, Artificial Sequence
  Description of Artificial Sequence: Synthetic oligonucleotide
  Description of Combined DNA/RNA Molecule: Synthetic oligonucleotide
cacccuugggcucuaugggtt

SEQ ID NO: 230 - DNA, 21 bp, Artificial Sequence
  Description of Artificial Sequence: Synthetic oligonucleotide
  Description of Combined DNA/RNA Molecule: Synthetic oligonucleotide
acccuugggcucuaugggatt

SEQ ID NO: 231 - DNA, 21 bp, Artificial Sequence
  Description of Artificial Sequence: Synthetic oligonucleotide
  Description of Combined DNA/RNA Molecule: Synthetic oligonucleotide
cccuugggcucuaugggaatt

SEQ ID NO: 232 - DNA, 21 bp, Artificial Sequence
  Description of Artificial Sequence: Synthetic oligonucleotide
  Description of Combined DNA/RNA Molecule: Synthetic oligonucleotide
ccuugggcucuaugggaagtt

SEQ ID NO: 233 - DNA, 21 bp, Artificial Sequence
  Description of Artificial Sequence: Synthetic oligonucleotide
  Description of Combined DNA/RNA Molecule: Synthetic oligonucleotide
cuugggcucuaugggaaggtt

SEQ ID NO: 234 - DNA, 21 bp, Artificial Sequence
  Description of Artificial Sequence: Synthetic oligonucleotide
  Description of Combined DNA/RNA Molecule: Synthetic oligonucleotide
uugggcucuaugggaaggatt

SEQ ID NO: 235 - DNA, 21 bp, Artificial Sequence
  Description of Artificial Sequence: Synthetic oligonucleotide
  Description of Combined DNA/RNA Molecule: Synthetic oligonucleotide
ugggcucuaugggaaggactt

SEQ ID NO: 236 - DNA, 21 bp, Artificial Sequence
  Description of Artificial Sequence: Synthetic oligonucleotide
  Description of Combined DNA/RNA Molecule: Synthetic oligonucleotide
gggcucuaugggaaggacctt

SEQ ID NO: 237 - DNA, 21 bp, Artificial Sequence
  Description of Artificial Sequence: Synthetic oligonucleotide
  Description of Combined DNA/RNA Molecule: Synthetic oligonucleotide
ggcucuaugggaaggaccatt

SEQ ID NO: 238 - DNA, 21 bp, Artificial Sequence
  Description of Artificial Sequence: Synthetic oligonucleotide
  Description of Combined DNA/RNA Molecule: Synthetic oligonucleotide
gcucuaugggaaggaccagtt

SEQ ID NO: 239 - DNA, 21 bp, Artificial Sequence
  Description of Artificial Sequence: Synthetic oligonucleotide
  Description of Combined DNA/RNA Molecule: Synthetic oligonucleotide
cucuaugggaaggaccagctt

SEQ ID NO: 240 - DNA, 21 bp, Artificial Sequence
  Description of Artificial Sequence: Synthetic oligonucleotide
  Description of Combined DNA/RNA Molecule: Synthetic oligonucleotide
ucuaugggaaggaccagcatt

SEQ ID NO: 241 - DNA, 21 bp, Artificial Sequence
  Description of Artificial Sequence: Synthetic oligonucleotide
  Description of Combined DNA/RNA Molecule: Synthetic oligonucleotide
cuaugggaaggaccagcagtt

SEQ ID NO: 242 - DNA, 21 bp, Artificial Sequence
  Description of Artificial Sequence: Synthetic oligonucleotide
  Description of Combined DNA/RNA Molecule: Synthetic oligonucleotide
uaugggaaggaccagcaggtt

SEQ ID NO: 243 - DNA, 21 bp, Artificial Sequence
  Description of Artificial Sequence: Synthetic oligonucleotide
  Description of Combined DNA/RNA Molecule: Synthetic oligonucleotide
augggaaggaccagcaggatt

SEQ ID NO: 244 - DNA, 21 bp, Artificial Sequence
  Description of Artificial Sequence: Synthetic oligonucleotide
  Description of Combined DNA/RNA Molecule: Synthetic oligonucleotide
ugggaaggaccagcaggagtt

SEQ ID NO: 245 - DNA, 21 bp, Artificial Sequence
  Description of Artificial Sequence: Synthetic oligonucleotide
  Description of Combined DNA/RNA Molecule: Synthetic oligonucleotide
gggaaggaccagcaggaggtt

SEQ ID NO: 246 - DNA, 21 bp, Artificial Sequence
  Description of Artificial Sequence: Synthetic oligonucleotide
  Description of Combined DNA/RNA Molecule: Synthetic oligonucleotide
ggaaggaccagcaggaggctt

SEQ ID NO: 247 - DNA, 21 bp, Artificial Sequence
  Description of Artificial Sequence: Synthetic oligonucleotide
  Description of Combined DNA/RNA Molecule: Synthetic oligonucleotide
gaaggaccagcaggaggcatt

SEQ ID NO: 248 - DNA, 21 bp, Artificial Sequence
  Description of Artificial Sequence: Synthetic oligonucleotide
  Description of Combined DNA/RNA Molecule: Synthetic oligonucleotide
aaggaccagcaggaggcagtt

SEQ ID NO: 249 - DNA, 21 bp, Artificial Sequence
  Description of Artificial Sequence: Synthetic oligonucleotide
  Description of Combined DNA/RNA Molecule: Synthetic oligonucleotide
aggaccagcaggaggcagctt

SEQ ID NO: 250 - DNA, 21 bp, Artificial Sequence
  Description of Artificial Sequence: Synthetic oligonucleotide
  Description of Combined DNA/RNA Molecule: Synthetic oligonucleotide
ggaccagcaggaggcagcctt

SEQ ID NO: 251 - DNA, 21 bp, Artificial Sequence
  Description of Artificial Sequence: Synthetic oligonucleotide
  Description of Combined DNA/RNA Molecule: Synthetic oligonucleotide
gaccagcaggaggcagccctt

SEQ ID NO: 252 - DNA, 21 bp, Artificial Sequence
  Description of Artificial Sequence: Synthetic oligonucleotide
  Description of Combined DNA/RNA Molecule: Synthetic oligonucleotide
accagcaggaggcagcccutt

SEQ ID NO: 253 - DNA, 21 bp, Artificial Sequence
  Description of Artificial Sequence: Synthetic oligonucleotide
  Description of Combined DNA/RNA Molecule: Synthetic oligonucleotide
ccagcaggaggcagcccugtt

SEQ ID NO: 254 - DNA, 21 bp, Artificial Sequence
  Description of Artificial Sequence: Synthetic oligonucleotide
  Description of Combined DNA/RNA Molecule: Synthetic oligonucleotide
cagcaggaggcagcccuggtt

SEQ ID NO: 255 - DNA, 21 bp, Artificial Sequence
  Description of Artificial Sequence: Synthetic oligonucleotide
  Description of Combined DNA/RNA Molecule: Synthetic oligonucleotide
agcaggaggcagcccuggutt

SEQ ID NO: 256 - DNA, 21 bp, Artificial Sequence
  Description of Artificial Sequence: Synthetic oligonucleotide
  Description of Combined DNA/RNA Molecule: Synthetic oligonucleotide
gcaggaggcagcccuggugtt

SEQ ID NO: 257 - DNA, 21 bp, Artificial Sequence
  Description of Artificial Sequence: Synthetic oligonucleotide
  Description of Combined DNA/RNA Molecule: Synthetic oligonucleotide
caggaggcagcccugguggtt

SEQ ID NO: 258 - DNA, 21 bp, Artificial Sequence
  Description of Artificial Sequence: Synthetic oligonucleotide
  Description of Combined DNA/RNA Molecule: Synthetic oligonucleotide
aggaggcagcccugguggatt

SEQ ID NO: 259 - DNA, 21 bp, Artificial Sequence
  Description of Artificial Sequence: Synthetic oligonucleotide
  Description of Combined DNA/RNA Molecule: Synthetic oligonucleotide
ggaggcagcccugguggactt

SEQ ID NO: 260 - DNA, 21 bp, Artificial Sequence
  Description of Artificial Sequence: Synthetic oligonucleotide
  Description of Combined DNA/RNA Molecule: Synthetic oligonucleotide
gaggcagcccugguggacatt

SEQ ID NO: 261 - DNA, 21 bp, Artificial Sequence
  Description of Artificial Sequence: Synthetic oligonucleotide
  Description of Combined DNA/RNA Molecule: Synthetic oligonucleotide
aggcagcccugguggacautt

SEQ ID NO: 262 - DNA, 21 bp, Artificial Sequence
  Description of Artificial Sequence: Synthetic oligonucleotide
  Description of Combined DNA/RNA Molecule: Synthetic oligonucleotide
ggcagcccugguggacaugtt

SEQ ID NO: 263 - DNA, 21 bp, Artificial Sequence
  Description of Artificial Sequence: Synthetic oligonucleotide
  Description of Combined DNA/RNA Molecule: Synthetic oligonucleotide
gcagcccugguggacauggtt

SEQ ID NO: 264 - DNA, 21 bp, Artificial Sequence
  Description of Artificial Sequence: Synthetic oligonucleotide
  Description of Combined DNA/RNA Molecule: Synthetic oligonucleotide
cagcccugguggacauggutt

SEQ ID NO: 265 - DNA, 21 bp, Artificial Sequence
  Description of Artificial Sequence: Synthetic oligonucleotide
  Description of Combined DNA/RNA Molecule: Synthetic oligonucleotide
agcccugguggacauggugtt

SEQ ID NO: 266 - DNA, 21 bp, Artificial Sequence
  Description of Artificial Sequence: Synthetic oligonucleotide
  Description of Combined DNA/RNA Molecule: Synthetic oligonucleotide
gcccugguggacauggugatt

SEQ ID NO: 267 - DNA, 21 bp, Artificial Sequence
  Description of Artificial Sequence: Synthetic oligonucleotide
  Description of Combined DNA/RNA Molecule: Synthetic oligonucleotide
cccugguggacauggugaatt

SEQ ID NO: 268 - DNA, 21 bp, Artificial Sequence
  Description of Artificial Sequence: Synthetic oligonucleotide
  Description of Combined DNA/RNA Molecule: Synthetic oligonucleotide
ccugguggacauggugaautt

SEQ ID NO: 269 - DNA, 21 bp, Artificial Sequence
  Description of Artificial Sequence: Synthetic oligonucleotide
  Description of Combined DNA/RNA Molecule: Synthetic oligonucleotide
cugguggacauggugaaugtt

SEQ ID NO: 270 - DNA, 21 bp, Artificial Sequence
  Description of Artificial Sequence: Synthetic oligonucleotide
  Description of Combined DNA/RNA Molecule: Synthetic oligonucleotide
ugguggacauggugaaugatt

SEQ ID NO: 271 - DNA, 21 bp, Artificial Sequence
  Description of Artificial Sequence: Synthetic oligonucleotide
  Description of Combined DNA/RNA Molecule: Synthetic oligonucleotide
gguggacauggugaaugactt

SEQ ID NO: 272 - DNA, 21 bp, Artificial Sequence
  Description of Artificial Sequence: Synthetic oligonucleotide
  Description of Combined DNA/RNA Molecule: Synthetic oligonucleotide
guggacauggugaaugacgtt

SEQ ID NO: 273 - DNA, 21 bp, Artificial Sequence
  Description of Artificial Sequence: Synthetic oligonucleotide
  Description of Combined DNA/RNA Molecule: Synthetic oligonucleotide
uggacauggugaaugacggtt

SEQ ID NO: 274 - DNA, 21 bp, Artificial Sequence
  Description of Artificial Sequence: Synthetic oligonucleotide
  Description of Combined DNA/RNA Molecule: Synthetic oligonucleotide
ggacauggugaaugacggctt

SEQ ID NO: 275 - DNA, 21 bp, Artificial Sequence
  Description of Artificial Sequence: Synthetic oligonucleotide
  Description of Combined DNA/RNA Molecule: Synthetic oligonucleotide
gacauggugaaugacggcgtt

SEQ ID NO: 276 - DNA, 21 bp, Artificial Sequence
  Description of Artificial Sequence: Synthetic oligonucleotide
  Description of Combined DNA/RNA Molecule: Synthetic oligonucleotide
acauggugaaugacggcgutt

SEQ ID NO: 277 - DNA, 21 bp, Artificial Sequence
  Description of Artificial Sequence: Synthetic oligonucleotide
  Description of Combined DNA/RNA Molecule: Synthetic oligonucleotide
cauggugaaugacggcgugtt

SEQ ID NO: 278 - DNA, 21 bp, Artificial Sequence
  Description of Artificial Sequence: Synthetic oligonucleotide
  Description of Combined DNA/RNA Molecule: Synthetic oligonucleotide
auggugaaugacggcguggtt

SEQ ID NO: 279 - DNA, 21 bp, Artificial Sequence
  Description of Artificial Sequence: Synthetic oligonucleotide
  Description of Combined DNA/RNA Molecule: Synthetic oligonucleotide
uggugaaugacggcguggatt

SEQ ID NO: 280 - DNA, 21 bp, Artificial Sequence
  Description of Artificial Sequence: Synthetic oligonucleotide
  Description of Combined DNA/RNA Molecule: Synthetic oligonucleotide
ggugaaugacggcguggagtt

SEQ ID NO: 281 - DNA, 21 bp, Artificial Sequence
  Description of Artificial Sequence: Synthetic oligonucleotide
  Description of Combined DNA/RNA Molecule: Synthetic oligonucleotide
gugaaugacggcguggaggtt

SEQ ID NO: 282 - DNA, 21 bp, Artificial Sequence
  Description of Artificial Sequence: Synthetic oligonucleotide
  Description of Combined DNA/RNA Molecule: Synthetic oligonucleotide
ugaaugacggcguggaggatt

SEQ ID NO: 283 - DNA, 21 bp, Artificial Sequence
  Description of Artificial Sequence: Synthetic oligonucleotide
  Description of Combined DNA/RNA Molecule: Synthetic oligonucleotide
gaaugacggcguggaggactt

SEQ ID NO: 284 - DNA, 21 bp, Artificial Sequence
  Description of Artificial Sequence: Synthetic oligonucleotide
  Description of Combined DNA/RNA Molecule: Synthetic oligonucleotide
aaugacggcguggaggacctt

SEQ ID NO: 285 - DNA, 21 bp, Artificial Sequence
  Description of Artificial Sequence: Synthetic oligonucleotide
  Description of Combined DNA/RNA Molecule: Synthetic oligonucleotide
augacggcguggaggaccutt

SEQ ID NO: 286 - DNA, 21 bp, Artificial Sequence
  Description of Artificial Sequence: Synthetic oligonucleotide
  Description of Combined DNA/RNA Molecule: Synthetic oligonucleotide
ugacggcguggaggaccuctt

SEQ ID NO: 287 - DNA, 21 bp, Artificial Sequence
  Description of Artificial Sequence: Synthetic oligonucleotide
  Description of Combined DNA/RNA Molecule: Synthetic oligonucleotide
gacggcguggaggaccucctt

SEQ ID NO: 288 - DNA, 21 bp, Artificial Sequence
  Description of Artificial Sequence: Synthetic oligonucleotide
  Description of Combined DNA/RNA Molecule: Synthetic oligonucleotide
acggcguggaggaccuccgtt

SEQ ID NO: 289 - DNA, 21 bp, Artificial Sequence
  Description of Artificial Sequence: Synthetic oligonucleotide
  Description of Combined DNA/RNA Molecule: Synthetic oligonucleotide
cggcguggaggaccuccgctt

SEQ ID NO: 290 - DNA, 21 bp, Artificial Sequence
  Description of Artificial Sequence: Synthetic oligonucleotide
  Description of Combined DNA/RNA Molecule: Synthetic oligonucleotide
ggcguggaggaccuccgcutt

SEQ ID NO: 291 - DNA, 21 bp, Artificial Sequence
  Description of Artificial Sequence: Synthetic oligonucleotide
  Description of Combined DNA/RNA Molecule: Synthetic oligonucleotide
gcguggaggaccuccgcugtt

SEQ ID NO: 292 - DNA, 21 bp, Artificial Sequence
  Description of Artificial Sequence: Synthetic oligonucleotide
  Description of Combined DNA/RNA Molecule: Synthetic oligonucleotide
cguggaggaccuccgcugctt

SEQ ID NO: 293 - DNA, 21 bp, Artificial Sequence
  Description of Artificial Sequence: Synthetic oligonucleotide
  Description of Combined DNA/RNA Molecule: Synthetic oligonucleotide
guggaggaccuccgcugcatt

SEQ ID NO: 294 - DNA, 21 bp, Artificial Sequence
  Description of Artificial Sequence: Synthetic oligonucleotide
  Description of Combined DNA/RNA Molecule: Synthetic oligonucleotide
uggaggaccuccgcugcaatt

SEQ ID NO: 295 - DNA, 21 bp, Artificial Sequence
  Description of Artificial Sequence: Synthetic oligonucleotide
  Description of Combined DNA/RNA Molecule: Synthetic oligonucleotide
ggaggaccuccgcugcaaatt

SEQ ID NO: 296 - DNA, 21 bp, Artificial Sequence
  Description of Artificial Sequence: Synthetic oligonucleotide
  Description of Combined DNA/RNA Molecule: Synthetic oligonucleotide
gaggaccuccgcugcaaautt

SEQ ID NO: 297 - DNA, 21 bp, Artificial Sequence
  Description of Artificial Sequence: Synthetic oligonucleotide
  Description of Combined DNA/RNA Molecule: Synthetic oligonucleotide
aggaccuccgcugcaaauatt

SEQ ID NO: 298 - DNA, 21 bp, Artificial Sequence
  Description of Artificial Sequence: Synthetic oligonucleotide
  Description of Combined DNA/RNA Molecule: Synthetic oligonucleotide
ggaccuccgcugcaaauactt

SEQ ID NO: 299 - DNA, 21 bp, Artificial Sequence
  Description of Artificial Sequence: Synthetic oligonucleotide
  Description of Combined DNA/RNA Molecule: Synthetic oligonucleotide
gaccuccgcugcaaauacatt

SEQ ID NO: 300 - DNA, 21 bp, Artificial Sequence
  Description of Artificial Sequence: Synthetic oligonucleotide
  Description of Combined DNA/RNA Molecule: Synthetic oligonucleotide
accuccgcugcaaauacautt

SEQ ID NO: 301 - DNA, 21 bp, Artificial Sequence
  Description of Artificial Sequence: Synthetic oligonucleotide
  Description of Combined DNA/RNA Molecule: Synthetic oligonucleotide
ccuccgcugcaaauacauctt

SEQ ID NO: 302 - DNA, 21 bp, Artificial Sequence
  Description of Artificial Sequence: Synthetic oligonucleotide
  Description of Combined DNA/RNA Molecule: Synthetic oligonucleotide
cuccgcugcaaauacaucutt

SEQ ID NO: 303 - DNA, 21 bp, Artificial Sequence
  Description of Artificial Sequence: Synthetic oligonucleotide
  Description of Combined DNA/RNA Molecule: Synthetic oligonucleotide
uccgcugcaaauacaucuctt

SEQ ID NO: 304 - DNA, 21 bp, Artificial Sequence
  Description of Artificial Sequence: Synthetic oligonucleotide
  Description of Combined DNA/RNA Molecule: Synthetic oligonucleotide
ccgcugcaaauacaucucctt

SEQ ID NO: 305 - DNA, 21 bp, Artificial Sequence
  Description of Artificial Sequence: Synthetic oligonucleotide
  Description of Combined DNA/RNA Molecule: Synthetic oligonucleotide
cgcugcaaauacaucuccctt

SEQ ID NO: 306 - DNA, 21 bp, Artificial Sequence
  Description of Artificial Sequence: Synthetic oligonucleotide
  Description of Combined DNA/RNA Molecule: Synthetic oligonucleotide
gcugcaaauacaucucccutt

SEQ ID NO: 307 - DNA, 21 bp, Artificial Sequence
  Description of Artificial Sequence: Synthetic oligonucleotide
  Description of Combined DNA/RNA Molecule: Synthetic oligonucleotide
cugcaaauacaucucccuctt

SEQ ID NO: 308 - DNA, 21 bp, Artificial Sequence
  Description of Artificial Sequence: Synthetic oligonucleotide
  Description of Combined DNA/RNA Molecule: Synthetic oligonucleotide
ugcaaauacaucucccucatt

SEQ ID NO: 309 - DNA, 21 bp, Artificial Sequence
  Description of Artificial Sequence: Synthetic oligonucleotide
  Description of Combined DNA/RNA Molecule: Synthetic oligonucleotide
gcaaauacaucucccucautt

SEQ ID NO: 310 - DNA, 21 bp, Artificial Sequence
  Description of Artificial Sequence: Synthetic oligonucleotide
  Description of Combined DNA/RNA Molecule: Synthetic oligonucleotide
caaauacaucucccucauctt

SEQ ID NO: 311 - DNA, 21 bp, Artificial Sequence
  Description of Artificial Sequence: Synthetic oligonucleotide
  Description of Combined DNA/RNA Molecule: Synthetic oligonucleotide
aaauacaucucccucaucutt

SEQ ID NO: 312 - DNA, 21 bp, Artificial Sequence
  Description of Artificial Sequence: Synthetic oligonucleotide
  Description of Combined DNA/RNA Molecule: Synthetic oligonucleotide
aauacaucucccucaucuatt

SEQ ID NO: 313 - DNA, 21 bp, Artificial Sequence
  Description of Artificial Sequence: Synthetic oligonucleotide
  Description of Combined DNA/RNA Molecule: Synthetic oligonucleotide
auacaucucccucaucuactt

SEQ ID NO: 314 - DNA, 21 bp, Artificial Sequence
  Description of Artificial Sequence: Synthetic oligonucleotide
  Description of Combined DNA/RNA Molecule: Synthetic oligonucleotide
uacaucucccucaucuacatt

SEQ ID NO: 315 - DNA, 21 bp, Artificial Sequence
  Description of Artificial Sequence: Synthetic oligonucleotide
  Description of Combined DNA/RNA Molecule: Synthetic oligonucleotide
acaucucccucaucuacactt

SEQ ID NO: 316 - DNA, 21 bp, Artificial Sequence
  Description of Artificial Sequence: Synthetic oligonucleotide
  Description of Combined DNA/RNA Molecule: Synthetic oligonucleotide
caucucccucaucuacacctt

SEQ ID NO: 317 - DNA, 21 bp, Artificial Sequence
  Description of Artificial Sequence: Synthetic oligonucleotide
  Description of Combined DNA/RNA Molecule: Synthetic oligonucleotide
aucucccucaucuacaccatt

SEQ ID NO: 318 - DNA, 21 bp, Artificial Sequence
  Description of Artificial Sequence: Synthetic oligonucleotide
  Description of Combined DNA/RNA Molecule: Synthetic oligonucleotide
ucucccucaucuacaccaatt

SEQ ID NO: 319 - DNA, 21 bp, Artificial Sequence
  Description of Artificial Sequence: Synthetic oligonucleotide
  Description of Combined DNA/RNA Molecule: Synthetic oligonucleotide
gcucccucaucuacaccaatt

SEQ ID NO: 320 - DNA, 21 bp, Artificial Sequence
  Description of Artificial Sequence: Synthetic oligonucleotide
  Description of Combined DNA/RNA Molecule: Synthetic oligonucleotide
cucccucaucuacaccaactt

SEQ ID NO: 321 - DNA, 21 bp, Artificial Sequence
  Description of Artificial Sequence: Synthetic oligonucleotide
  Description of Combined DNA/RNA Molecule: Synthetic oligonucleotide
ucccucaucuacaccaacutt

SEQ ID NO: 322 - DNA, 21 bp, Artificial Sequence
  Description of Artificial Sequence: Synthetic oligonucleotide
  Description of Combined DNA/RNA Molecule: Synthetic oligonucleotide
cucccucaucuacaccaaatt

SEQ ID NO: 323 - DNA, 21 bp, Artificial Sequence
  Description of Artificial Sequence: Synthetic oligonucleotide
  Description of Combined DNA/RNA Molecule: Synthetic oligonucleotide
cccucaucuacaccaacuatt

SEQ ID NO: 324 - DNA, 21 bp, Artificial Sequence
  Description of Artificial Sequence: Synthetic oligonucleotide
  Description of Combined DNA/RNA Molecule: Synthetic oligonucleotide
ccucaucuacaccaacuautt

SEQ ID NO: 325 - DNA, 21 bp, Artificial Sequence
  Description of Artificial Sequence: Synthetic oligonucleotide
  Description of Combined DNA/RNA Molecule: Synthetic oligonucleotide
ccucaucuacaccaacuaatt

SEQ ID NO: 326 - DNA, 21 bp, Artificial Sequence
  Description of Artificial Sequence: Synthetic oligonucleotide
  Description of Combined DNA/RNA Molecule: Synthetic oligonucleotide
cucaucuacaccaacuaugtt

SEQ ID NO: 327 - DNA, 21 bp, Artificial Sequence
  Description of Artificial Sequence: Synthetic oligonucleotide
  Description of Combined DNA/RNA Molecule: Synthetic oligonucleotide
ucaucuacaccaacuaugatt

SEQ ID NO: 328 - DNA, 21 bp, Artificial Sequence
  Description of Artificial Sequence: Synthetic oligonucleotide
  Description of Combined DNA/RNA Molecule: Synthetic oligonucleotide
caucuacaccaacuaugagtt

SEQ ID NO: 329 - DNA, 21 bp, Artificial Sequence
  Description of Artificial Sequence: Synthetic oligonucleotide
  Description of Combined DNA/RNA Molecule: Synthetic oligonucleotide
aucuacaccaacuaugaggtt

SEQ ID NO: 330 - DNA, 21 bp, Artificial Sequence
  Description of Artificial Sequence: Synthetic oligonucleotide
  Description of Combined DNA/RNA Molecule: Synthetic oligonucleotide
ucuacaccaacuaugaggctt

SEQ ID NO: 331 - DNA, 21 bp, Artificial Sequence
  Description of Artificial Sequence: Synthetic oligonucleotide
  Description of Combined DNA/RNA Molecule: Synthetic oligonucleotide
cuacaccaacuaugaggcgtt

SEQ ID NO: 332 - DNA, 21 bp, Artificial Sequence
  Description of Artificial Sequence: Synthetic oligonucleotide
  Description of Combined DNA/RNA Molecule: Synthetic oligonucleotide
uacaccaacuaugaggcggtt

SEQ ID NO: 333 - DNA, 21 bp, Artificial Sequence
  Description of Artificial Sequence: Synthetic oligonucleotide
  Description of Combined DNA/RNA Molecule: Synthetic oligonucleotide
acaccaacuaugaggcgggtt

SEQ ID NO: 334 - DNA, 21 bp, Artificial Sequence
  Description of Artificial Sequence: Synthetic oligonucleotide
  Description of Combined DNA/RNA Molecule: Synthetic oligonucleotide
caccaacuaugaggcgggctt

SEQ ID NO: 335 - DNA, 21 bp, Artificial Sequence
  Description of Artificial Sequence: Synthetic oligonucleotide
  Description of Combined DNA/RNA Molecule: Synthetic oligonucleotide
accaacuaugaggcgggcatt

SEQ ID NO: 336 - DNA, 21 bp, Artificial Sequence
  Description of Artificial Sequence: Synthetic oligonucleotide
  Description of Combined DNA/RNA Molecule: Synthetic oligonucleotide
ccaacuaugaggcgggcaatt

SEQ ID NO: 337 - DNA, 21 bp, Artificial Sequence
  Description of Artificial Sequence: Synthetic oligonucleotide
  Description of Combined DNA/RNA Molecule: Synthetic oligonucleotide
caacuaugaggcgggcaagtt

SEQ ID NO: 338 - DNA, 21 bp, Artificial Sequence
  Description of Artificial Sequence: Synthetic oligonucleotide
  Description of Combined DNA/RNA Molecule: Synthetic oligonucleotide
aacuaugaggcgggcaaggtt

SEQ ID NO: 339 - DNA, 21 bp, Artificial Sequence
  Description of Artificial Sequence: Synthetic oligonucleotide
  Description of Combined DNA/RNA Molecule: Synthetic oligonucleotide
acuaugaggcgggcaaggatt

SEQ ID NO: 340 - DNA, 21 bp, Artificial Sequence
  Description of Artificial Sequence: Synthetic oligonucleotide
  Description of Combined DNA/RNA Molecule: Synthetic oligonucleotide
cuaugaggcgggcaaggautt

SEQ ID NO: 341 - DNA, 21 bp, Artificial Sequence
  Description of Artificial Sequence: Synthetic oligonucleotide
  Description of Combined DNA/RNA Molecule: Synthetic oligonucleotide
uaugaggcgggcaaggaugtt

SEQ ID NO: 342 - DNA, 21 bp, Artificial Sequence
  Description of Artificial Sequence: Synthetic oligonucleotide
  Description of Combined DNA/RNA Molecule: Synthetic oligonucleotide
augaggcgggcaaggaugatt

SEQ ID NO: 343 - DNA, 21 bp, Artificial Sequence
  Description of Artificial Sequence: Synthetic oligonucleotide
  Description of Combined DNA/RNA Molecule: Synthetic oligonucleotide
ugaggcgggcaaggaugactt

SEQ ID NO: 344 - DNA, 21 bp, Artificial Sequence
  Description of Artificial Sequence: Synthetic oligonucleotide
  Description of Combined DNA/RNA Molecule: Synthetic oligonucleotide
gaggcgggcaaggaugacutt

SEQ ID NO: 345 - DNA, 21 bp, Artificial Sequence
  Description of Artificial Sequence: Synthetic oligonucleotide
  Description of Combined DNA/RNA Molecule: Synthetic oligonucleotide
aggcgggcaaggaugacuatt

SEQ ID NO: 346 - DNA, 21 bp, Artificial Sequence
  Description of Artificial Sequence: Synthetic oligonucleotide
  Description of Combined DNA/RNA Molecule: Synthetic oligonucleotide
ggcgggcaaggaugacuautt

SEQ ID NO: 347 - DNA, 21 bp, Artificial Sequence
  Description of Artificial Sequence: Synthetic oligonucleotide
  Description of Combined DNA/RNA Molecule: Synthetic oligonucleotide
gcgggcaaggaugacuaugtt

SEQ ID NO: 348 - DNA, 21 bp, Artificial Sequence
  Description of Artificial Sequence: Synthetic oligonucleotide
  Description of Combined DNA/RNA Molecule: Synthetic oligonucleotide
cgggcaaggaugacuaugutt

SEQ ID NO: 349 - DNA, 21 bp, Artificial Sequence
  Description of Artificial Sequence: Synthetic oligonucleotide
  Description of Combined DNA/RNA Molecule: Synthetic oligonucleotide
gggcaaggaugacuaugugtt

SEQ ID NO: 350 - DNA, 21 bp, Artificial Sequence
  Description of Artificial Sequence: Synthetic oligonucleotide
  Description of Combined DNA/RNA Molecule: Synthetic oligonucleotide
ggcaaggaugacuaugugatt

SEQ ID NO: 351 - DNA, 21 bp, Artificial Sequence
  Description of Artificial Sequence: Synthetic oligonucleotide
  Description of Combined DNA/RNA Molecule: Synthetic oligonucleotide
gcaaggaugacuaugugaatt

SEQ ID NO: 352 - DNA, 21 bp, Artificial Sequence
  Description of Artificial Sequence: Synthetic oligonucleotide
  Description of Combined DNA/RNA Molecule: Synthetic oligonucleotide
caaggaugacuaugugaagtt

SEQ ID NO: 353 - DNA, 21 bp, Artificial Sequence
  Description of Artificial Sequence: Synthetic oligonucleotide
  Description of Combined DNA/RNA Molecule: Synthetic oligonucleotide
aaggaugacuaugugaaggtt

SEQ ID NO: 354 - DNA, 21 bp, Artificial Sequence
  Description of Artificial Sequence: Synthetic oligonucleotide
  Description of Combined DNA/RNA Molecule: Synthetic oligonucleotide
aggaugacuaugugaaggctt

SEQ ID NO: 355 - DNA, 21 bp, Artificial Sequence
  Description of Artificial Sequence: Synthetic oligonucleotide
  Description of Combined DNA/RNA Molecule: Synthetic oligonucleotide
ggaugacuaugugaaggcatt

SEQ ID NO: 356 - DNA, 21 bp, Artificial Sequence
  Description of Artificial Sequence: Synthetic oligonucleotide
  Description of Combined DNA/RNA Molecule: Synthetic oligonucleotide
gaugacuaugugaaggcactt

SEQ ID NO: 357 - DNA, 21 bp, Artificial Sequence
  Description of Artificial Sequence: Synthetic oligonucleotide
  Description of Combined DNA/RNA Molecule: Synthetic oligonucleotide
augacuaugugaaggcacutt

SEQ ID NO: 358 - DNA, 21 bp, Artificial Sequence
  Description of Artificial Sequence: Synthetic oligonucleotide
  Description of Combined DNA/RNA Molecule: Synthetic oligonucleotide
ugacuaugugaaggcacugtt

SEQ ID NO: 359 - DNA, 21 bp, Artificial Sequence
  Description of Artificial Sequence: Synthetic oligonucleotide
  Description of Combined DNA/RNA Molecule: Synthetic oligonucleotide
gacuaugugaaggcacugctt

SEQ ID NO: 360 - DNA, 21 bp, Artificial Sequence
  Description of Artificial Sequence: Synthetic oligonucleotide
  Description of Combined DNA/RNA Molecule: Synthetic oligonucleotide
acuaugugaaggcacugcctt

SEQ ID NO: 361 - DNA, 21 bp, Artificial Sequence
  Description of Artificial Sequence: Synthetic oligonucleotide
  Description of Combined DNA/RNA Molecule: Synthetic oligonucleotide
cuaugugaaggcacugccctt

SEQ ID NO: 362 - DNA, 21 bp, Artificial Sequence
  Description of Artificial Sequence: Synthetic oligonucleotide
  Description of Combined DNA/RNA Molecule: Synthetic oligonucleotide
uaugugaaggcacugcccgtt

SEQ ID NO: 363 - DNA, 21 bp, Artificial Sequence
  Description of Artificial Sequence: Synthetic oligonucleotide
  Description of Combined DNA/RNA Molecule: Synthetic oligonucleotide
augugaaggcacugcccggtt

SEQ ID NO: 364 - DNA, 21 bp, Artificial Sequence
  Description of Artificial Sequence: Synthetic oligonucleotide
  Description of Combined DNA/RNA Molecule: Synthetic oligonucleotide
ugugaaggcacugcccgggtt

SEQ ID NO: 365 - DNA, 21 bp, Artificial Sequence
  Description of Artificial Sequence: Synthetic oligonucleotide
  Description of Combined DNA/RNA Molecule: Synthetic oligonucleotide
gugaaggcacugcccgggctt

SEQ ID NO: 366 - DNA, 21 bp, Artificial Sequence
  Description of Artificial Sequence: Synthetic oligonucleotide
  Description of Combined DNA/RNA Molecule: Synthetic oligonucleotide
ugaaggcacugcccgggcatt

SEQ ID NO: 367 - DNA, 21 bp, Artificial Sequence
  Description of Artificial Sequence: Synthetic oligonucleotide
  Description of Combined DNA/RNA Molecule: Synthetic oligonucleotide
gaaggcacugcccgggcaatt

SEQ ID NO: 368 - DNA, 21 bp, Artificial Sequence
  Description of Artificial Sequence: Synthetic oligonucleotide
  Description of Combined DNA/RNA Molecule: Synthetic oligonucleotide
aaggcacugcccgggcaactt

SEQ ID NO: 369 - DNA, 21 bp, Artificial Sequence
  Description of Artificial Sequence: Synthetic oligonucleotide
  Description of Combined DNA/RNA Molecule: Synthetic oligonucleotide
aggcacugcccgggcaacutt

SEQ ID NO: 370 - DNA, 21 bp, Artificial Sequence
  Description of Artificial Sequence: Synthetic oligonucleotide
  Description of Combined DNA/RNA Molecule: Synthetic oligonucleotide
ggcacugcccgggcaacugtt

SEQ ID NO: 371 - DNA, 21 bp, Artificial Sequence
  Description of Artificial Sequence: Synthetic oligonucleotide
  Description of Combined DNA/RNA Molecule: Synthetic oligonucleotide
gcacugcccgggcaacugatt

SEQ ID NO: 372 - DNA, 21 bp, Artificial Sequence
  Description of Artificial Sequence: Synthetic oligonucleotide
  Description of Combined DNA/RNA Molecule: Synthetic oligonucleotide
cacugcccgggcaacugaatt

SEQ ID NO: 373 - DNA, 21 bp, Artificial Sequence
  Description of Artificial Sequence: Synthetic oligonucleotide
  Description of Combined DNA/RNA Molecule: Synthetic oligonucleotide
acugcccgggcaacugaagtt

SEQ ID NO: 374 - DNA, 21 bp, Artificial Sequence
  Description of Artificial Sequence: Synthetic oligonucleotide
  Description of Combined DNA/RNA Molecule: Synthetic oligonucleotide
cugcccgggcaacugaagctt

SEQ ID NO: 375 - DNA, 21 bp, Artificial Sequence
  Description of Artificial Sequence: Synthetic oligonucleotide
  Description of Combined DNA/RNA Molecule: Synthetic oligonucleotide
ugcccgggcaacugaagcctt

SEQ ID NO: 376 - DNA, 21 bp, Artificial Sequence
  Description of Artificial Sequence: Synthetic oligonucleotide
  Description of Combined DNA/RNA Molecule: Synthetic oligonucleotide
gcccgggcaacugaagccutt

SEQ ID NO: 377 - DNA, 21 bp, Artificial Sequence
  Description of Artificial Sequence: Synthetic oligonucleotide
  Description of Combined DNA/RNA Molecule: Synthetic oligonucleotide
cccgggcaacugaagccuutt

SEQ ID NO: 378 - DNA, 21 bp, Artificial Sequence
  Description of Artificial Sequence: Synthetic oligonucleotide
  Description of Combined DNA/RNA Molecule: Synthetic oligonucleotide
ccgggcaacugaagccuuutt

SEQ ID NO: 379 - DNA, 21 bp, Artificial Sequence
  Description of Artificial Sequence: Synthetic oligonucleotide
  Description of Combined DNA/RNA Molecule: Synthetic oligonucleotide
cgggcaacugaagccuuuutt

SEQ ID NO: 380 - DNA, 21 bp, Artificial Sequence
  Description of Artificial Sequence: Synthetic oligonucleotide
  Description of Combined DNA/RNA Molecule: Synthetic oligonucleotide
gggcaacugaagccuuuugtt

SEQ ID NO: 381 - DNA, 21 bp, Artificial Sequence
  Description of Artificial Sequence: Synthetic oligonucleotide
  Description of Combined DNA/RNA Molecule: Synthetic oligonucleotide
ggcaacugaagccuuuugatt

SEQ ID NO: 382 - DNA, 21 bp, Artificial Sequence
  Description of Artificial Sequence: Synthetic oligonucleotide
  Description of Combined DNA/RNA Molecule: Synthetic oligonucleotide
gcaacugaagccuuuugagtt

SEQ ID NO: 383 - DNA, 21 bp, Artificial Sequence
  Description of Artificial Sequence: Synthetic oligonucleotide
  Description of Combined DNA/RNA Molecule: Synthetic oligonucleotide
caacugaagccuuuugagatt

SEQ ID NO: 384 - DNA, 21 bp, Artificial Sequence
  Description of Artificial Sequence: Synthetic oligonucleotide
  Description of Combined DNA/RNA Molecule: Synthetic oligonucleotide
aacugaagccuuuugagactt

SEQ ID NO: 385 - DNA, 21 bp, Artificial Sequence
  Description of Artificial Sequence: Synthetic oligonucleotide
  Description of Combined DNA/RNA Molecule: Synthetic oligonucleotide
acugaagccuuuugagacctt

SEQ ID NO: 386 - DNA, 21 bp, Artificial Sequence
  Description of Artificial Sequence: Synthetic oligonucleotide
  Description of Combined DNA/RNA Molecule: Synthetic oligonucleotide
acugaagccuuuugagacatt

SEQ ID NO: 387 - DNA, 21 bp, Artificial Sequence
  Description of Artificial Sequence: Synthetic oligonucleotide
  Description of Combined DNA/RNA Molecule: Synthetic oligonucleotide
cugaagccuuuugagaccctt

SEQ ID NO: 388 - DNA, 21 bp, Artificial Sequence
  Description of Artificial Sequence: Synthetic oligonucleotide
  Description of Combined DNA/RNA Molecule: Synthetic oligonucleotide
ugaagccuuuugagacccutt

SEQ ID NO: 389 - DNA, 21 bp, Artificial Sequence
  Description of Artificial Sequence: Synthetic oligonucleotide
  Description of Combined DNA/RNA Molecule: Synthetic oligonucleotide
gaagccuuuugagacccugtt

SEQ ID NO: 390 - DNA, 21 bp, Artificial Sequence
  Description of Artificial Sequence: Synthetic oligonucleotide
  Description of Combined DNA/RNA Molecule: Synthetic oligonucleotide
aagccuuuugagacccugctt

SEQ ID NO: 391 - DNA, 21 bp, Artificial Sequence
  Description of Artificial Sequence: Synthetic oligonucleotide
  Description of Combined DNA/RNA Molecule: Synthetic oligonucleotide
gaagccuuuugagacccuatt

SEQ ID NO: 392 - DNA, 21 bp, Artificial Sequence
  Description of Artificial Sequence: Synthetic oligonucleotide
  Description of Combined DNA/RNA Molecule: Synthetic oligonucleotide
agccuuuugagacccugcutt

SEQ ID NO: 393 - DNA, 21 bp, Artificial Sequence
  Description of Artificial Sequence: Synthetic oligonucleotide
  Description of Combined DNA/RNA Molecule: Synthetic oligonucleotide
cgccuuuugagacccugcatt

SEQ ID NO: 394 - DNA, 21 bp, Artificial Sequence
  Description of Artificial Sequence: Synthetic oligonucleotide
  Description of Combined DNA/RNA Molecule: Synthetic oligonucleotide
agccuuuugagacccugcatt

SEQ ID NO: 395 - DNA, 21 bp, Artificial Sequence
  Description of Artificial Sequence: Synthetic oligonucleotide
  Description of Combined DNA/RNA Molecule: Synthetic oligonucleotide
gccuuuugagacccugcugtt

SEQ ID NO: 396 - DNA, 21 bp, Artificial Sequence
  Description of Artificial Sequence: Synthetic oligonucleotide
  Description of Combined DNA/RNA Molecule: Synthetic oligonucleotide
ccuuuugagacccugcugutt

SEQ ID NO: 397 - DNA, 21 bp, Artificial Sequence
  Description of Artificial Sequence: Synthetic oligonucleotide
  Description of Combined DNA/RNA Molecule: Synthetic oligonucleotide
ccuuuugagacccugcugatt

SEQ ID NO: 398 - DNA, 21 bp, Artificial Sequence
  Description of Artificial Sequence: Synthetic oligonucleotide
  Description of Combined DNA/RNA Molecule: Synthetic oligonucleotide
cuuuugagacccugcuguctt

SEQ ID NO: 399 - DNA, 21 bp, Artificial Sequence
  Description of Artificial Sequence: Synthetic oligonucleotide
  Description of Combined DNA/RNA Molecule: Synthetic oligonucleotide
cuuuugagacccugcuguatt

SEQ ID NO: 400 - DNA, 21 bp, Artificial Sequence
  Description of Artificial Sequence: Synthetic oligonucleotide
  Description of Combined DNA/RNA Molecule: Synthetic oligonucleotide
uuuugagacccugcugucctt

SEQ ID NO: 401 - DNA, 21 bp, Artificial Sequence
  Description of Artificial Sequence: Synthetic oligonucleotide
  Description of Combined DNA/RNA Molecule: Synthetic oligonucleotide
uuugagacccugcuguccctt

SEQ ID NO: 402 - DNA, 21 bp, Artificial Sequence
  Description of Artificial Sequence: Synthetic oligonucleotide
  Description of Combined DNA/RNA Molecule: Synthetic oligonucleotide
uugagacccugcugucccatt

SEQ ID NO: 403 - DNA, 21 bp, Artificial Sequence
  Description of Artificial Sequence: Synthetic oligonucleotide
  Description of Combined DNA/RNA Molecule: Synthetic oligonucleotide
ugagacccugcugucccagtt

SEQ ID NO: 404 - DNA, 21 bp, Artificial Sequence
  Description of Artificial Sequence: Synthetic oligonucleotide
  Description of Combined DNA/RNA Molecule: Synthetic oligonucleotide
gagacccugcugucccagatt

SEQ ID NO: 405 - DNA, 21 bp, Artificial Sequence
  Description of Artificial Sequence: Synthetic oligonucleotide
  Description of Combined DNA/RNA Molecule: Synthetic oligonucleotide
agacccugcugucccagaatt

SEQ ID NO: 406 - DNA, 21 bp, Artificial Sequence
  Description of Artificial Sequence: Synthetic oligonucleotide
  Description of Combined DNA/RNA Molecule: Synthetic oligonucleotide
gacccugcugucccagaactt

SEQ ID NO: 407 - DNA, 21 bp, Artificial Sequence
  Description of Artificial Sequence: Synthetic oligonucleotide
  Description of Combined DNA/RNA Molecule: Synthetic oligonucleotide
acccugcugucccagaacctt

SEQ ID NO: 408 - DNA, 21 bp, Artificial Sequence
  Description of Artificial Sequence: Synthetic oligonucleotide
  Description of Combined DNA/RNA Molecule: Synthetic oligonucleotide
acccugcugucccagaacatt

SEQ ID NO: 409 - DNA, 21 bp, Artificial Sequence
  Description of Artificial Sequence: Synthetic oligonucleotide
  Description of Combined DNA/RNA Molecule: Synthetic oligonucleotide
cccugcugucccagaaccatt

SEQ ID NO: 410 - DNA, 21 bp, Artificial Sequence
  Description of Artificial Sequence: Synthetic oligonucleotide
  Description of Combined DNA/RNA Molecule: Synthetic oligonucleotide
ccugcugucccagaaccagtt

SEQ ID NO: 411 - DNA, 21 bp, Artificial Sequence
  Description of Artificial Sequence: Synthetic oligonucleotide
  Description of Combined DNA/RNA Molecule: Synthetic oligonucleotide
cugcugucccagaaccaggtt

SEQ ID NO: 412 - DNA, 21 bp, Artificial Sequence
  Description of Artificial Sequence: Synthetic oligonucleotide
  Description of Combined DNA/RNA Molecule: Synthetic oligonucleotide
ugcugucccagaaccagggtt

SEQ ID NO: 413 - DNA, 21 bp, Artificial Sequence
  Description of Artificial Sequence: Synthetic oligonucleotide
  Description of Combined DNA/RNA Molecule: Synthetic oligonucleotide
ugcugucccagaaccaggatt

SEQ ID NO: 414 - DNA, 21 bp, Artificial Sequence
  Description of Artificial Sequence: Synthetic oligonucleotide
  Description of Combined DNA/RNA Molecule: Synthetic oligonucleotide
gcugucccagaaccagggatt

SEQ ID NO: 415 - DNA, 21 bp, Artificial Sequence
  Description of Artificial Sequence: Synthetic oligonucleotide
  Description of Combined DNA/RNA Molecule: Synthetic oligonucleotide
cugucccagaaccagggagtt

SEQ ID NO: 416 - DNA, 21 bp, Artificial Sequence
  Description of Artificial Sequence: Synthetic oligonucleotide
  Description of Combined DNA/RNA Molecule: Synthetic oligonucleotide
ugucccagaaccagggaggtt

SEQ ID NO: 417 - DNA, 21 bp, Artificial Sequence
  Description of Artificial Sequence: Synthetic oligonucleotide
  Description of Combined DNA/RNA Molecule: Synthetic oligonucleotide
gucccagaaccagggaggctt

SEQ ID NO: 418 - DNA, 21 bp, Artificial Sequence
  Description of Artificial Sequence: Synthetic oligonucleotide
  Description of Combined DNA/RNA Molecule: Synthetic oligonucleotide
ucccagaaccagggaggcatt

SEQ ID NO: 419 - DNA, 21 bp, Artificial Sequence
  Description of Artificial Sequence: Synthetic oligonucleotide
  Description of Combined DNA/RNA Molecule: Synthetic oligonucleotide
cccagaaccagggaggcaatt

SEQ ID NO: 420 - DNA, 21 bp, Artificial Sequence
  Description of Artificial Sequence: Synthetic oligonucleotide
  Description of Combined DNA/RNA Molecule: Synthetic oligonucleotide
ccagaaccagggaggcaagtt

SEQ ID NO: 421 - DNA, 21 bp, Artificial Sequence
  Description of Artificial Sequence: Synthetic oligonucleotide
  Description of Combined DNA/RNA Molecule: Synthetic oligonucleotide
cagaaccagggaggcaagatt

SEQ ID NO: 422 - DNA, 21 bp, Artificial Sequence
  Description of Artificial Sequence: Synthetic oligonucleotide
  Description of Combined DNA/RNA Molecule: Synthetic oligonucleotide
agaaccagggaggcaagactt

SEQ ID NO: 423 - DNA, 21 bp, Artificial Sequence
  Description of Artificial Sequence: Synthetic oligonucleotide
  Description of Combined DNA/RNA Molecule: Synthetic oligonucleotide
gaaccagggaggcaagacctt

SEQ ID NO: 424 - DNA, 21 bp, Artificial Sequence
  Description of Artificial Sequence: Synthetic oligonucleotide
  Description of Combined DNA/RNA Molecule: Synthetic oligonucleotide
aaccagggaggcaagaccutt

SEQ ID NO: 425 - DNA, 21 bp, Artificial Sequence
  Description of Artificial Sequence: Synthetic oligonucleotide
  Description of Combined DNA/RNA Molecule: Synthetic oligonucleotide
accagggaggcaagaccuutt

SEQ ID NO: 426 - DNA, 21 bp, Artificial Sequence
  Description of Artificial Sequence: Synthetic oligonucleotide
  Description of Combined DNA/RNA Molecule: Synthetic oligonucleotide
ccagggaggcaagaccuuctt

SEQ ID NO: 427 - DNA, 21 bp, Artificial Sequence
  Description of Artificial Sequence: Synthetic oligonucleotide
  Description of Combined DNA/RNA Molecule: Synthetic oligonucleotide
cagggaggcaagaccuucatt

SEQ ID NO: 428 - DNA, 21 bp, Artificial Sequence
  Description of Artificial Sequence: Synthetic oligonucleotide
  Description of Combined DNA/RNA Molecule: Synthetic oligonucleotide
agggaggcaagaccuucautt

SEQ ID NO: 429 - DNA, 21 bp, Artificial Sequence
  Description of Artificial Sequence: Synthetic oligonucleotide
  Description of Combined DNA/RNA Molecule: Synthetic oligonucleotide
gggaggcaagaccuucauutt

SEQ ID NO: 430 - DNA, 21 bp, Artificial Sequence
  Description of Artificial Sequence: Synthetic oligonucleotide
  Description of Combined DNA/RNA Molecule: Synthetic oligonucleotide
ggaggcaagaccuucauugtt

SEQ ID NO: 431 - DNA, 21 bp, Artificial Sequence
  Description of Artificial Sequence: Synthetic oligonucleotide
  Description of Combined DNA/RNA Molecule: Synthetic oligonucleotide
gaggcaagaccuucauugutt

SEQ ID NO: 432 - DNA, 21 bp, Artificial Sequence
  Description of Artificial Sequence: Synthetic oligonucleotide
  Description of Combined DNA/RNA Molecule: Synthetic oligonucleotide
aggcaagaccuucauugugtt

SEQ ID NO: 433 - DNA, 21 bp, Artificial Sequence
  Description of Artificial Sequence: Synthetic oligonucleotide
  Description of Combined DNA/RNA Molecule: Synthetic oligonucleotide
ggcaagaccuucauuguggtt

SEQ ID NO: 434 - DNA, 21 bp, Artificial Sequence
  Description of Artificial Sequence: Synthetic oligonucleotide
  Description of Combined DNA/RNA Molecule: Synthetic oligonucleotide
gcaagaccuucauugugggtt

SEQ ID NO: 435 - DNA, 21 bp, Artificial Sequence
  Description of Artificial Sequence: Synthetic oligonucleotide
  Description of Combined DNA/RNA Molecule: Synthetic oligonucleotide
caagaccuucauugugggatt

SEQ ID NO: 436 - DNA, 21 bp, Artificial Sequence
  Description of Artificial Sequence: Synthetic oligonucleotide
  Description of Combined DNA/RNA Molecule: Synthetic oligonucleotide
aagaccuucauugugggagtt

SEQ ID NO: 437 - DNA, 21 bp, Artificial Sequence
  Description of Artificial Sequence: Synthetic oligonucleotide
  Description of Combined DNA/RNA Molecule: Synthetic oligonucleotide
agaccuucauugugggagatt

SEQ ID NO: 438 - DNA, 21 bp, Artificial Sequence
  Description of Artificial Sequence: Synthetic oligonucleotide
  Description of Combined DNA/RNA Molecule: Synthetic oligonucleotide
gaccuucauugugggagactt

SEQ ID NO: 439 - DNA, 21 bp, Artificial Sequence
  Description of Artificial Sequence: Synthetic oligonucleotide
  Description of Combined DNA/RNA Molecule: Synthetic oligonucleotide
accuucauugugggagacctt

SEQ ID NO: 440 - DNA, 21 bp, Artificial Sequence
  Description of Artificial Sequence: Synthetic oligonucleotide
  Description of Combined DNA/RNA Molecule: Synthetic oligonucleotide
ccuucauugugggagaccatt

SEQ ID NO: 441 - DNA, 21 bp, Artificial Sequence
  Description of Artificial Sequence: Synthetic oligonucleotide
  Description of Combined DNA/RNA Molecule: Synthetic oligonucleotide
cuucauugugggagaccagtt

SEQ ID NO: 442 - DNA, 21 bp, Artificial Sequence
  Description of Artificial Sequence: Synthetic oligonucleotide
  Description of Combined DNA/RNA Molecule: Synthetic oligonucleotide
uucauugugggagaccagatt

SEQ ID NO: 443 - DNA, 21 bp, Artificial Sequence
  Description of Artificial Sequence: Synthetic oligonucleotide
  Description of Combined DNA/RNA Molecule: Synthetic oligonucleotide
ucauugugggagaccagautt

SEQ ID NO: 444 - DNA, 21 bp, Artificial Sequence
  Description of Artificial Sequence: Synthetic oligonucleotide
  Description of Combined DNA/RNA Molecule: Synthetic oligonucleotide
cauugugggagaccagauctt

SEQ ID NO: 445 - DNA, 21 bp, Artificial Sequence
  Description of Artificial Sequence: Synthetic oligonucleotide
  Description of Combined DNA/RNA Molecule: Synthetic oligonucleotide
auugugggagaccagaucutt

SEQ ID NO: 446 - DNA, 21 bp, Artificial Sequence
  Description of Artificial Sequence: Synthetic oligonucleotide
  Description of Combined DNA/RNA Molecule: Synthetic oligonucleotide
uugugggagaccagaucuctt

SEQ ID NO: 447 - DNA, 21 bp, Artificial Sequence
  Description of Artificial Sequence: Synthetic oligonucleotide
  Description of Combined DNA/RNA Molecule: Synthetic oligonucleotide
ugugggagaccagaucucctt

SEQ ID NO: 448 - DNA, 21 bp, Artificial Sequence
  Description of Artificial Sequence: Synthetic oligonucleotide
  Description of Combined DNA/RNA Molecule: Synthetic oligonucleotide
gugggagaccagaucuccutt

SEQ ID NO: 449 - DNA, 21 bp, Artificial Sequence
  Description of Artificial Sequence: Synthetic oligonucleotide
  Description of Combined DNA/RNA Molecule: Synthetic oligonucleotide
ugggagaccagaucuccuutt

SEQ ID NO: 450 - DNA, 21 bp, Artificial Sequence
  Description of Artificial Sequence: Synthetic oligonucleotide
  Description of Combined DNA/RNA Molecule: Synthetic oligonucleotide
gggagaccagaucuccuuctt

SEQ ID NO: 451 - DNA, 21 bp, Artificial Sequence
  Description of Artificial Sequence: Synthetic oligonucleotide
  Description of Combined DNA/RNA Molecule: Synthetic oligonucleotide
ggagaccagaucuccuucgtt

SEQ ID NO: 452 - DNA, 21 bp, Artificial Sequence
  Description of Artificial Sequence: Synthetic oligonucleotide
  Description of Combined DNA/RNA Molecule: Synthetic oligonucleotide
gagaccagaucuccuucgctt

SEQ ID NO: 453 - DNA, 21 bp, Artificial Sequence
  Description of Artificial Sequence: Synthetic oligonucleotide
  Description of Combined DNA/RNA Molecule: Synthetic oligonucleotide
agaccagaucuccuucgcutt

SEQ ID NO: 454 - DNA, 21 bp, Artificial Sequence
  Description of Artificial Sequence: Synthetic oligonucleotide
  Description of Combined DNA/RNA Molecule: Synthetic oligonucleotide
gaccagaucuccuucgcugtt

SEQ ID NO: 455 - DNA, 21 bp, Artificial Sequence
  Description of Artificial Sequence: Synthetic oligonucleotide
  Description of Combined DNA/RNA Molecule: Synthetic oligonucleotide
accagaucuccuucgcugatt

SEQ ID NO: 456 - DNA, 21 bp, Artificial Sequence
  Description of Artificial Sequence: Synthetic oligonucleotide
  Description of Combined DNA/RNA Molecule: Synthetic oligonucleotide
ccagaucuccuucgcugactt

SEQ ID NO: 457 - DNA, 21 bp, Artificial Sequence
  Description of Artificial Sequence: Synthetic oligonucleotide
  Description of Combined DNA/RNA Molecule: Synthetic oligonucleotide
cagaucuccuucgcugacutt

SEQ ID NO: 458 - DNA, 21 bp, Artificial Sequence
  Description of Artificial Sequence: Synthetic oligonucleotide
  Description of Combined DNA/RNA Molecule: Synthetic oligonucleotide
agaucuccuucgcugacuatt

SEQ ID NO: 459 - DNA, 21 bp, Artificial Sequence
  Description of Artificial Sequence: Synthetic oligonucleotide
  Description of Combined DNA/RNA Molecule: Synthetic oligonucleotide
gaucuccuucgcugacuactt

SEQ ID NO: 460 - DNA, 21 bp, Artificial Sequence
  Description of Artificial Sequence: Synthetic oligonucleotide
  Description of Combined DNA/RNA Molecule: Synthetic oligonucleotide
aucuccuucgcugacuacatt

SEQ ID NO: 461 - DNA, 21 bp, Artificial Sequence
  Description of Artificial Sequence: Synthetic oligonucleotide
  Description of Combined DNA/RNA Molecule: Synthetic oligonucleotide
ucuccuucgcugacuacaatt

SEQ ID NO: 462 - DNA, 21 bp, Artificial Sequence
  Description of Artificial Sequence: Synthetic oligonucleotide
  Description of Combined DNA/RNA Molecule: Synthetic oligonucleotide
cuccuucgcugacuacaactt

SEQ ID NO: 463 - DNA, 21 bp, Artificial Sequence
  Description of Artificial Sequence: Synthetic oligonucleotide
  Description of Combined DNA/RNA Molecule: Synthetic oligonucleotide
uccuucgcugacuacaacctt

SEQ ID NO: 464 - DNA, 21 bp, Artificial Sequence
  Description of Artificial Sequence: Synthetic oligonucleotide
  Description of Combined DNA/RNA Molecule: Synthetic oligonucleotide
ccuucgcugacuacaaccutt

SEQ ID NO: 465 - DNA, 21 bp, Artificial Sequence
  Description of Artificial Sequence: Synthetic oligonucleotide
  Description of Combined DNA/RNA Molecule: Synthetic oligonucleotide
cuucgcugacuacaaccugtt

SEQ ID NO: 466 - DNA, 21 bp, Artificial Sequence
  Description of Artificial Sequence: Synthetic oligonucleotide
  Description of Combined DNA/RNA Molecule: Synthetic oligonucleotide
uucgcugacuacaaccugctt

SEQ ID NO: 467 - DNA, 21 bp, Artificial Sequence
  Description of Artificial Sequence: Synthetic oligonucleotide
  Description of Combined DNA/RNA Molecule: Synthetic oligonucleotide
ucgcugacuacaaccugcutt

SEQ ID NO: 468 - DNA, 21 bp, Artificial Sequence
  Description of Artificial Sequence: Synthetic oligonucleotide
  Description of Combined DNA/RNA Molecule: Synthetic oligonucleotide
cgcugacuacaaccugcugtt

SEQ ID NO: 469 - DNA, 21 bp, Artificial Sequence
  Description of Artificial Sequence: Synthetic oligonucleotide
  Description of Combined DNA/RNA Molecule: Synthetic oligonucleotide
gcugacuacaaccugcuggtt

SEQ ID NO: 470 - DNA, 21 bp, Artificial Sequence
  Description of Artificial Sequence: Synthetic oligonucleotide
  Description of Combined DNA/RNA Molecule: Synthetic oligonucleotide
cugacuacaaccugcuggatt

SEQ ID NO: 471 - DNA, 21 bp, Artificial Sequence
  Description of Artificial Sequence: Synthetic oligonucleotide
  Description of Combined DNA/RNA Molecule: Synthetic oligonucleotide
ugacuacaaccugcuggactt

SEQ ID NO: 472 - DNA, 21 bp, Artificial Sequence
  Description of Artificial Sequence: Synthetic oligonucleotide
  Description of Combined DNA/RNA Molecule: Synthetic oligonucleotide
gacuacaaccugcuggacutt

SEQ ID NO: 473 - DNA, 21 bp, Artificial Sequence
  Description of Artificial Sequence: Synthetic oligonucleotide
  Description of Combined DNA/RNA Molecule: Synthetic oligonucleotide
acuacaaccugcuggacuutt

SEQ ID NO: 474 - DNA, 21 bp, Artificial Sequence
  Description of Artificial Sequence: Synthetic oligonucleotide
  Description of Combined DNA/RNA Molecule: Synthetic oligonucleotide
cuacaaccugcuggacuugtt

SEQ ID NO: 475 - DNA, 21 bp, Artificial Sequence
  Description of Artificial Sequence: Synthetic oligonucleotide
  Description of Combined DNA/RNA Molecule: Synthetic oligonucleotide
uacaaccugcuggacuugctt

SEQ ID NO: 476 - DNA, 21 bp, Artificial Sequence
  Description of Artificial Sequence: Synthetic oligonucleotide
  Description of Combined DNA/RNA Molecule: Synthetic oligonucleotide
acaaccugcuggacuugcutt

SEQ ID NO: 477 - DNA, 21 bp, Artificial Sequence
  Description of Artificial Sequence: Synthetic oligonucleotide
  Description of Combined DNA/RNA Molecule: Synthetic oligonucleotide
caaccugcuggacuugcugtt

SEQ ID NO: 478 - DNA, 21 bp, Artificial Sequence
  Description of Artificial Sequence: Synthetic oligonucleotide
  Description of Combined DNA/RNA Molecule: Synthetic oligonucleotide
aaccugcuggacuugcugctt

SEQ ID NO: 479 - DNA, 21 bp, Artificial Sequence
  Description of Artificial Sequence: Synthetic oligonucleotide
  Description of Combined DNA/RNA Molecule: Synthetic oligonucleotide
accugcuggacuugcugcutt

SEQ ID NO: 480 - DNA, 21 bp, Artificial Sequence
  Description of Artificial Sequence: Synthetic oligonucleotide
  Description of Combined DNA/RNA Molecule: Synthetic oligonucleotide
ccugcuggacuugcugcugtt

SEQ ID NO: 481 - DNA, 21 bp, Artificial Sequence
  Description of Artificial Sequence: Synthetic oligonucleotide
  Description of Combined DNA/RNA Molecule: Synthetic oligonucleotide
cugcuggacuugcugcugatt

SEQ ID NO: 482 - DNA, 21 bp, Artificial Sequence
  Description of Artificial Sequence: Synthetic oligonucleotide
  Description of Combined DNA/RNA Molecule: Synthetic oligonucleotide
ugcuggacuugcugcugautt

SEQ ID NO: 483 - DNA, 21 bp, Artificial Sequence
  Description of Artificial Sequence: Synthetic oligonucleotide
  Description of Combined DNA/RNA Molecule: Synthetic oligonucleotide
gcuggacuugcugcugauctt

SEQ ID NO: 484 - DNA, 21 bp, Artificial Sequence
  Description of Artificial Sequence: Synthetic oligonucleotide
  Description of Combined DNA/RNA Molecule: Synthetic oligonucleotide
cuggacuugcugcugaucctt

SEQ ID NO: 485 - DNA, 21 bp, Artificial Sequence
  Description of Artificial Sequence: Synthetic oligonucleotide
  Description of Combined DNA/RNA Molecule: Synthetic oligonucleotide
uggacuugcugcugauccatt

SEQ ID NO: 486 - DNA, 21 bp, Artificial Sequence
  Description of Artificial Sequence: Synthetic oligonucleotide
  Description of Combined DNA/RNA Molecule: Synthetic oligonucleotide
ggacuugcugcugauccautt

SEQ ID NO: 487 - DNA, 21 bp, Artificial Sequence
  Description of Artificial Sequence: Synthetic oligonucleotide
  Description of Combined DNA/RNA Molecule: Synthetic oligonucleotide
gacuugcugcugauccaugtt

SEQ ID NO: 488 - DNA, 21 bp, Artificial Sequence
  Description of Artificial Sequence: Synthetic oligonucleotide
  Description of Combined DNA/RNA Molecule: Synthetic oligonucleotide
acuugcugcugauccaugatt

SEQ ID NO: 489 - DNA, 21 bp, Artificial Sequence
  Description of Artificial Sequence: Synthetic oligonucleotide
  Description of Combined DNA/RNA Molecule: Synthetic oligonucleotide
cuugcugcugauccaugagtt

SEQ ID NO: 490 - DNA, 21 bp, Artificial Sequence
  Description of Artificial Sequence: Synthetic oligonucleotide
  Description of Combined DNA/RNA Molecule: Synthetic oligonucleotide
uugcugcugauccaugaggtt

SEQ ID NO: 491 - DNA, 21 bp, Artificial Sequence
  Description of Artificial Sequence: Synthetic oligonucleotide
  Description of Combined DNA/RNA Molecule: Synthetic oligonucleotide
ugcugcugauccaugaggutt

SEQ ID NO: 492 - DNA, 21 bp, Artificial Sequence
  Description of Artificial Sequence: Synthetic oligonucleotide
  Description of Combined DNA/RNA Molecule: Synthetic oligonucleotide
gcugcugauccaugagguctt

SEQ ID NO: 493 - DNA, 21 bp, Artificial Sequence
  Description of Artificial Sequence: Synthetic oligonucleotide
  Description of Combined DNA/RNA Molecule: Synthetic oligonucleotide
cugcugauccaugaggucctt

SEQ ID NO: 494 - DNA, 21 bp, Artificial Sequence
  Description of Artificial Sequence: Synthetic oligonucleotide
  Description of Combined DNA/RNA Molecule: Synthetic oligonucleotide
ugcugauccaugagguccutt

SEQ ID NO: 495 - DNA, 21 bp, Artificial Sequence
  Description of Artificial Sequence: Synthetic oligonucleotide
  Description of Combined DNA/RNA Molecule: Synthetic oligonucleotide
gcugauccaugagguccuatt

SEQ ID NO: 496 - DNA, 21 bp, Artificial Sequence
  Description of Artificial Sequence: Synthetic oligonucleotide
  Description of Combined DNA/RNA Molecule: Synthetic oligonucleotide
cugauccaugagguccuagtt

SEQ ID NO: 497 - DNA, 21 bp, Artificial Sequence
  Description of Artificial Sequence: Synthetic oligonucleotide
  Description of Combined DNA/RNA Molecule: Synthetic oligonucleotide
ugauccaugagguccuagctt

SEQ ID NO: 498 - DNA, 21 bp, Artificial Sequence
  Description of Artificial Sequence: Synthetic oligonucleotide
  Description of Combined DNA/RNA Molecule: Synthetic oligonucleotide
gauccaugagguccuagcctt

SEQ ID NO: 499 - DNA, 21 bp, Artificial Sequence
  Description of Artificial Sequence: Synthetic oligonucleotide
  Description of Combined DNA/RNA Molecule: Synthetic oligonucleotide
auccaugagguccuagccctt

SEQ ID NO: 500 - DNA, 21 bp, Artificial Sequence
  Description of Artificial Sequence: Synthetic oligonucleotide
  Description of Combined DNA/RNA Molecule: Synthetic oligonucleotide
cccuggcugccuggaugcgtt

SEQ ID NO: 501 - DNA, 21 bp, Artificial Sequence
  Description of Artificial Sequence: Synthetic oligonucleotide
  Description of Combined DNA/RNA Molecule: Synthetic oligonucleotide
ccuggcugccuggaugcgutt

SEQ ID NO: 502 - DNA, 21 bp, Artificial Sequence
  Description of Artificial Sequence: Synthetic oligonucleotide
  Description of Combined DNA/RNA Molecule: Synthetic oligonucleotide
cuggcugccuggaugcguutt

SEQ ID NO: 503 - DNA, 21 bp, Artificial Sequence
  Description of Artificial Sequence: Synthetic oligonucleotide
  Description of Combined DNA/RNA Molecule: Synthetic oligonucleotide
uggcugccuggaugcguuctt

SEQ ID NO: 504 - DNA, 21 bp, Artificial Sequence
  Description of Artificial Sequence: Synthetic oligonucleotide
  Description of Combined DNA/RNA Molecule: Synthetic oligonucleotide
ggcugccuggaugcguucctt

SEQ ID NO: 505 - DNA, 21 bp, Artificial Sequence
  Description of Artificial Sequence: Synthetic oligonucleotide
  Description of Combined DNA/RNA Molecule: Synthetic oligonucleotide
gcugccuggaugcguuccctt

SEQ ID NO: 506 - DNA, 21 bp, Artificial Sequence
  Description of Artificial Sequence: Synthetic oligonucleotide
  Description of Combined DNA/RNA Molecule: Synthetic oligonucleotide
cccugcucucagcauaugutt

SEQ ID NO: 507 - DNA, 21 bp, Artificial Sequence
  Description of Artificial Sequence: Synthetic oligonucleotide
  Description of Combined DNA/RNA Molecule: Synthetic oligonucleotide
ccugcucucagcauaugugtt

SEQ ID NO: 508 - DNA, 21 bp, Artificial Sequence
  Description of Artificial Sequence: Synthetic oligonucleotide
  Description of Combined DNA/RNA Molecule: Synthetic oligonucleotide
cugcucucagcauauguggtt

SEQ ID NO: 509 - DNA, 21 bp, Artificial Sequence
  Description of Artificial Sequence: Synthetic oligonucleotide
  Description of Combined DNA/RNA Molecule: Synthetic oligonucleotide
ugcucucagcauaugugggtt

SEQ ID NO: 510 - DNA, 21 bp, Artificial Sequence
  Description of Artificial Sequence: Synthetic oligonucleotide
  Description of Combined DNA/RNA Molecule: Synthetic oligonucleotide
gggcgccucagugcccggctt

SEQ ID NO: 511 - DNA, 21 bp, Artificial Sequence
  Description of Artificial Sequence: Synthetic oligonucleotide
  Description of Combined DNA/RNA Molecule: Synthetic oligonucleotide
ggcgccucagugcccggcctt

SEQ ID NO: 512 - DNA, 21 bp, Artificial Sequence
  Description of Artificial Sequence: Synthetic oligonucleotide
  Description of Combined DNA/RNA Molecule: Synthetic oligonucleotide
gcgccucagugcccggccctt

SEQ ID NO: 513 - DNA, 21 bp, Artificial Sequence
  Description of Artificial Sequence: Synthetic oligonucleotide
  Description of Combined DNA/RNA Molecule: Synthetic oligonucleotide
cgccucagugcccggcccatt

SEQ ID NO: 514 - DNA, 21 bp, Artificial Sequence
  Description of Artificial Sequence: Synthetic oligonucleotide
  Description of Combined DNA/RNA Molecule: Synthetic oligonucleotide
gccucagugcccggcccaatt

SEQ ID NO: 515 - DNA, 21 bp, Artificial Sequence
  Description of Artificial Sequence: Synthetic oligonucleotide
  Description of Combined DNA/RNA Molecule: Synthetic oligonucleotide
ccucagugcccggcccaagtt

SEQ ID NO: 516 - DNA, 21 bp, Artificial Sequence
  Description of Artificial Sequence: Synthetic oligonucleotide
  Description of Combined DNA/RNA Molecule: Synthetic oligonucleotide
cucagugcccggcccaagctt

SEQ ID NO: 517 - DNA, 21 bp, Artificial Sequence
  Description of Artificial Sequence: Synthetic oligonucleotide
  Description of Combined DNA/RNA Molecule: Synthetic oligonucleotide
ucagugcccggcccaagcutt

SEQ ID NO: 518 - DNA, 21 bp, Artificial Sequence
  Description of Artificial Sequence: Synthetic oligonucleotide
  Description of Combined DNA/RNA Molecule: Synthetic oligonucleotide
cagugcccggcccaagcuctt

SEQ ID NO: 519 - DNA, 21 bp, Artificial Sequence
  Description of Artificial Sequence: Synthetic oligonucleotide
  Description of Combined DNA/RNA Molecule: Synthetic oligonucleotide
agugcccggcccaagcucatt

SEQ ID NO: 520 - DNA, 21 bp, Artificial Sequence
  Description of Artificial Sequence: Synthetic oligonucleotide
  Description of Combined DNA/RNA Molecule: Synthetic oligonucleotide
gugcccggcccaagcucaatt

SEQ ID NO: 521 - DNA, 21 bp, Artificial Sequence
  Description of Artificial Sequence: Synthetic oligonucleotide
  Description of Combined DNA/RNA Molecule: Synthetic oligonucleotide
ugcccggcccaagcucaagtt

SEQ ID NO: 522 - DNA, 21 bp, Artificial Sequence
  Description of Artificial Sequence: Synthetic oligonucleotide
  Description of Combined DNA/RNA Molecule: Synthetic oligonucleotide
gcccggcccaagcucaaggtt

SEQ ID NO: 523 - DNA, 21 bp, Artificial Sequence
  Description of Artificial Sequence: Synthetic oligonucleotide
  Description of Combined DNA/RNA Molecule: Synthetic oligonucleotide
cccggcccaagcucaaggctt

SEQ ID NO: 524 - DNA, 21 bp, Artificial Sequence
  Description of Artificial Sequence: Synthetic oligonucleotide
  Description of Combined DNA/RNA Molecule: Synthetic oligonucleotide
ccggcccaagcucaaggcctt

SEQ ID NO: 525 - DNA, 21 bp, Artificial Sequence
  Description of Artificial Sequence: Synthetic oligonucleotide
  Description of Combined DNA/RNA Molecule: Synthetic oligonucleotide
cggcccaagcucaaggccutt

SEQ ID NO: 526 - DNA, 21 bp, Artificial Sequence
  Description of Artificial Sequence: Synthetic oligonucleotide
  Description of Combined DNA/RNA Molecule: Synthetic oligonucleotide
ggcccaagcucaaggccuutt

SEQ ID NO: 527 - DNA, 21 bp, Artificial Sequence
  Description of Artificial Sequence: Synthetic oligonucleotide
  Description of Combined DNA/RNA Molecule: Synthetic oligonucleotide
gcccaagcucaaggccuuctt

SEQ ID NO: 528 - DNA, 21 bp, Artificial Sequence
  Description of Artificial Sequence: Synthetic oligonucleotide
  Description of Combined DNA/RNA Molecule: Synthetic oligonucleotide
cccaagcucaaggccuucctt

SEQ ID NO: 529 - DNA, 21 bp, Artificial Sequence
  Description of Artificial Sequence: Synthetic oligonucleotide
  Description of Combined DNA/RNA Molecule: Synthetic oligonucleotide
ccaagcucaaggccuuccutt

SEQ ID NO: 530 - DNA, 21 bp, Artificial Sequence
  Description of Artificial Sequence: Synthetic oligonucleotide
  Description of Combined DNA/RNA Molecule: Synthetic oligonucleotide
caagcucaaggccuuccugtt

SEQ ID NO: 531 - DNA, 21 bp, Artificial Sequence
  Description of Artificial Sequence: Synthetic oligonucleotide
  Description of Combined DNA/RNA Molecule: Synthetic oligonucleotide
aagcucaaggccuuccuggtt

SEQ ID NO: 532 - DNA, 21 bp, Artificial Sequence
  Description of Artificial Sequence: Synthetic oligonucleotide
  Description of Combined DNA/RNA Molecule: Synthetic oligonucleotide
agcucaaggccuuccuggctt

SEQ ID NO: 533 - DNA, 21 bp, Artificial Sequence
  Description of Artificial Sequence: Synthetic oligonucleotide
  Description of Combined DNA/RNA Molecule: Synthetic oligonucleotide
gcucaaggccuuccuggcctt

SEQ ID NO: 534 - DNA, 21 bp, Artificial Sequence
  Description of Artificial Sequence: Synthetic oligonucleotide
  Description of Combined DNA/RNA Molecule: Synthetic oligonucleotide
cucaaggccuuccuggccutt

SEQ ID NO: 535 - DNA, 21 bp, Artificial Sequence
  Description of Artificial Sequence: Synthetic oligonucleotide
  Description of Combined DNA/RNA Molecule: Synthetic oligonucleotide
ucaaggccuuccuggccuctt

SEQ ID NO: 536 - DNA, 21 bp, Artificial Sequence
  Description of Artificial Sequence: Synthetic oligonucleotide
  Description of Combined DNA/RNA Molecule: Synthetic oligonucleotide
caaggccuuccuggccucctt

SEQ ID NO: 537 - DNA, 21 bp, Artificial Sequence
  Description of Artificial Sequence: Synthetic oligonucleotide
  Description of Combined DNA/RNA Molecule: Synthetic oligonucleotide
aaggccuuccuggccuccctt

SEQ ID NO: 538 - DNA, 21 bp, Artificial Sequence
  Description of Artificial Sequence: Synthetic oligonucleotide
  Description of Combined DNA/RNA Molecule: Synthetic oligonucleotide
cccugaguacgugaaccuctt

SEQ ID NO: 539 - DNA, 21 bp, Artificial Sequence
  Description of Artificial Sequence: Synthetic oligonucleotide
  Description of Combined DNA/RNA Molecule: Synthetic oligonucleotide
ccugaguacgugaaccucctt

SEQ ID NO: 540 - DNA, 21 bp, Artificial Sequence
  Description of Artificial Sequence: Synthetic oligonucleotide
  Description of Combined DNA/RNA Molecule: Synthetic oligonucleotide
cugaguacgugaaccuccctt

SEQ ID NO: 541 - DNA, 21 bp, Artificial Sequence
  Description of Artificial Sequence: Synthetic oligonucleotide
  Description of Combined DNA/RNA Molecule: Synthetic oligonucleotide
cccaucaauggcaacgggatt

SEQ ID NO: 542 - DNA, 21 bp, Artificial Sequence
  Description of Artificial Sequence: Synthetic oligonucleotide
  Description of Combined DNA/RNA Molecule: Synthetic oligonucleotide
ccaucaauggcaacgggaatt

SEQ ID NO: 543 - DNA, 21 bp, Artificial Sequence
  Description of Artificial Sequence: Synthetic oligonucleotide
  Description of Combined DNA/RNA Molecule: Synthetic oligonucleotide
caucaauggcaacgggaaatt

SEQ ID NO: 544 - DNA, 21 bp, Artificial Sequence
  Description of Artificial Sequence: Synthetic oligonucleotide
  Description of Combined DNA/RNA Molecule: Synthetic oligonucleotide
aucaauggcaacgggaaactt

SEQ ID NO: 545 - DNA, 21 bp, Artificial Sequence
  Description of Artificial Sequence: Synthetic oligonucleotide
  Description of Combined DNA/RNA Molecule: Synthetic oligonucleotide
ucaauggcaacgggaaacatt

SEQ ID NO: 546 - DNA, 21 bp, Artificial Sequence
  Description of Artificial Sequence: Synthetic oligonucleotide
  Description of Combined DNA/RNA Molecule: Synthetic oligonucleotide
caauggcaacgggaaacagtt

SEQ ID NO: 547 - DNA, 21 bp, Artificial Sequence
  Description of Artificial Sequence: Synthetic oligonucleotide
  Description of Combined DNA/RNA Molecule: Synthetic oligonucleotide
aauggcaacgggaaacagutt

SEQ ID NO: 548 - DNA, 21 bp, Artificial Sequence
  Description of Artificial Sequence: Synthetic oligonucleotide
  Description of Combined DNA/RNA Molecule: Synthetic oligonucleotide
auggcaacgggaaacagugtt

SEQ ID NO: 549 - DNA, 21 bp, Artificial Sequence
  Description of Artificial Sequence: Synthetic oligonucleotide
  Description of Combined DNA/RNA Molecule: Synthetic oligonucleotide
uggcaacgggaaacagugatt

SEQ ID NO: 550 - DNA, 21 bp, Artificial Sequence
  Description of Artificial Sequence: Synthetic oligonucleotide
  Description of Combined DNA/RNA Molecule: Synthetic oligonucleotide
ggcaacgggaaacagugagtt

SEQ ID NO: 551 - DNA, 21 bp, Artificial Sequence
  Description of Artificial Sequence: Synthetic oligonucleotide
  Description of Combined DNA/RNA Molecule: Synthetic oligonucleotide
gcaacgggaaacagugaggtt

SEQ ID NO: 552 - DNA, 21 bp, Artificial Sequence
  Description of Artificial Sequence: Synthetic oligonucleotide
  Description of Combined DNA/RNA Molecule: Synthetic oligonucleotide
caacgggaaacagugagggtt

SEQ ID NO: 553 - DNA, 21 bp, Artificial Sequence
  Description of Artificial Sequence: Synthetic oligonucleotide
  Description of Combined DNA/RNA Molecule: Synthetic oligonucleotide
aacgggaaacagugagggutt

SEQ ID NO: 554 - DNA, 21 bp, Artificial Sequence
  Description of Artificial Sequence: Synthetic oligonucleotide
  Description of Combined DNA/RNA Molecule: Synthetic oligonucleotide
acgggaaacagugaggguutt

SEQ ID NO: 555 - DNA, 21 bp, Artificial Sequence
  Description of Artificial Sequence: Synthetic oligonucleotide
  Description of Combined DNA/RNA Molecule: Synthetic oligonucleotide
cgggaaacagugaggguugtt

SEQ ID NO: 556 - DNA, 21 bp, Artificial Sequence
  Description of Artificial Sequence: Synthetic oligonucleotide
  Description of Combined DNA/RNA Molecule: Synthetic oligonucleotide
gggaaacagugaggguuggtt

SEQ ID NO: 557 - DNA, 21 bp, Artificial Sequence
  Description of Artificial Sequence: Synthetic oligonucleotide
  Description of Combined DNA/RNA Molecule: Synthetic oligonucleotide
ggaaacagugaggguugggtt

SEQ ID NO: 558 - DNA, 21 bp, Artificial Sequence
  Description of Artificial Sequence: Synthetic oligonucleotide
  Description of Combined DNA/RNA Molecule: Synthetic oligonucleotide
gggacucugagcgggaggctt

SEQ ID NO: 559 - DNA, 21 bp, Artificial Sequence
  Description of Artificial Sequence: Synthetic oligonucleotide
  Description of Combined DNA/RNA Molecule: Synthetic oligonucleotide
ggacucugagcgggaggcatt

SEQ ID NO: 560 - DNA, 21 bp, Artificial Sequence
  Description of Artificial Sequence: Synthetic oligonucleotide
  Description of Combined DNA/RNA Molecule: Synthetic oligonucleotide
acucugagcgggaggcagatt

SEQ ID NO: 561 - DNA, 21 bp, Artificial Sequence
  Description of Artificial Sequence: Synthetic oligonucleotide
  Description of Combined DNA/RNA Molecule: Synthetic oligonucleotide
ucugagcgggaggcagagutt

SEQ ID NO: 562 - DNA, 21 bp, Artificial Sequence
  Description of Artificial Sequence: Synthetic oligonucleotide
  Description of Combined DNA/RNA Molecule: Synthetic oligonucleotide
cugagcgggaggcagaguutt

SEQ ID NO: 563 - DNA, 21 bp, Artificial Sequence
  Description of Artificial Sequence: Synthetic oligonucleotide
  Description of Combined DNA/RNA Molecule: Synthetic oligonucleotide
ugagcgggaggcagaguuutt

SEQ ID NO: 564 - DNA, 21 bp, Artificial Sequence
  Description of Artificial Sequence: Synthetic oligonucleotide
  Description of Combined DNA/RNA Molecule: Synthetic oligonucleotide
gagcgggaggcagaguuugtt

SEQ ID NO: 565 - DNA, 21 bp, Artificial Sequence
  Description of Artificial Sequence: Synthetic oligonucleotide
  Description of Combined DNA/RNA Molecule: Synthetic oligonucleotide
agcgggaggcagaguuugctt

SEQ ID NO: 566 - DNA, 21 bp, Artificial Sequence
  Description of Artificial Sequence: Synthetic oligonucleotide
  Description of Combined DNA/RNA Molecule: Synthetic oligonucleotide
gcgggaggcagaguuugcctt

SEQ ID NO: 567 - DNA, 21 bp, Artificial Sequence
  Description of Artificial Sequence: Synthetic oligonucleotide
  Description of Combined DNA/RNA Molecule: Synthetic oligonucleotide
cgggaggcagaguuugccutt

SEQ ID NO: 568 - DNA, 21 bp, Artificial Sequence
  Description of Artificial Sequence: Synthetic oligonucleotide
  Description of Combined DNA/RNA Molecule: Synthetic oligonucleotide
gggaggcagaguuugccuutt

SEQ ID NO: 569 - DNA, 21 bp, Artificial Sequence
  Description of Artificial Sequence: Synthetic oligonucleotide
  Description of Combined DNA/RNA Molecule: Synthetic oligonucleotide
ggaggcagaguuugccuuctt

SEQ ID NO: 570 - DNA, 21 bp, Artificial Sequence
  Description of Artificial Sequence: Synthetic oligonucleotide
  Description of Combined DNA/RNA Molecule: Synthetic oligonucleotide
gaggcagaguuugccuucctt

SEQ ID NO: 571 - DNA, 21 bp, Artificial Sequence
  Description of Artificial Sequence: Synthetic oligonucleotide
  Description of Combined DNA/RNA Molecule: Synthetic oligonucleotide
aggcagaguuugccuuccutt

SEQ ID NO: 572 - DNA, 21 bp, Artificial Sequence
  Description of Artificial Sequence: Synthetic oligonucleotide
  Description of Combined DNA/RNA Molecule: Synthetic oligonucleotide
ggcagaguuugccuuccuutt

SEQ ID NO: 573 - DNA, 21 bp, Artificial Sequence
  Description of Artificial Sequence: Synthetic oligonucleotide
  Description of Combined DNA/RNA Molecule: Synthetic oligonucleotide
gcagaguuugccuuccuuutt

SEQ ID NO: 574 - DNA, 21 bp, Artificial Sequence
  Description of Artificial Sequence: Synthetic oligonucleotide
  Description of Combined DNA/RNA Molecule: Synthetic oligonucleotide
cagaguuugccuuccuuuctt

SEQ ID NO: 575 - DNA, 21 bp, Artificial Sequence
  Description of Artificial Sequence: Synthetic oligonucleotide
  Description of Combined DNA/RNA Molecule: Synthetic oligonucleotide
agaguuugccuuccuuucutt

SEQ ID NO: 576 - DNA, 21 bp, Artificial Sequence
  Description of Artificial Sequence: Synthetic oligonucleotide
  Description of Combined DNA/RNA Molecule: Synthetic oligonucleotide
gaguuugccuuccuuucuctt

SEQ ID NO: 577 - DNA, 21 bp, Artificial Sequence
  Description of Artificial Sequence: Synthetic oligonucleotide
  Description of Combined DNA/RNA Molecule: Synthetic oligonucleotide
aguuugccuuccuuucucctt

SEQ ID NO: 578 - DNA, 21 bp, Artificial Sequence
  Description of Artificial Sequence: Synthetic oligonucleotide
  Description of Combined DNA/RNA Molecule: Synthetic oligonucleotide
guuugccuuccuuucuccatt

SEQ ID NO: 579 - DNA, 21 bp, Artificial Sequence
  Description of Artificial Sequence: Synthetic oligonucleotide
  Description of Combined DNA/RNA Molecule: Synthetic oligonucleotide
uuugccuuccuuucuccagtt

SEQ ID NO: 580 - DNA, 21 bp, Artificial Sequence
  Description of Artificial Sequence: Synthetic oligonucleotide
  Description of Combined DNA/RNA Molecule: Synthetic oligonucleotide
uugccuuccuuucuccaggtt

SEQ ID NO: 581 - DNA, 21 bp, Artificial Sequence
  Description of Artificial Sequence: Synthetic oligonucleotide
  Description of Combined DNA/RNA Molecule: Synthetic oligonucleotide
ugccuuccuuucuccaggatt

SEQ ID NO: 582 - DNA, 21 bp, Artificial Sequence
  Description of Artificial Sequence: Synthetic oligonucleotide
  Description of Combined DNA/RNA Molecule: Synthetic oligonucleotide
gccuuccuuucuccaggactt

SEQ ID NO: 583 - DNA, 21 bp, Artificial Sequence
  Description of Artificial Sequence: Synthetic oligonucleotide
  Description of Combined DNA/RNA Molecule: Synthetic oligonucleotide
ccuuccuuucuccaggacctt

SEQ ID NO: 584 - DNA, 21 bp, Artificial Sequence
  Description of Artificial Sequence: Synthetic oligonucleotide
  Description of Combined DNA/RNA Molecule: Synthetic oligonucleotide
cuuccuuucuccaggaccatt

SEQ ID NO: 585 - DNA, 21 bp, Artificial Sequence
  Description of Artificial Sequence: Synthetic oligonucleotide
  Description of Combined DNA/RNA Molecule: Synthetic oligonucleotide
uuccuuucuccaggaccaatt

SEQ ID NO: 586 - DNA, 21 bp, Artificial Sequence
  Description of Artificial Sequence: Synthetic oligonucleotide
  Description of Combined DNA/RNA Molecule: Synthetic oligonucleotide
uccuuucuccaggaccaautt

SEQ ID NO: 587 - DNA, 21 bp, Artificial Sequence
  Description of Artificial Sequence: Synthetic oligonucleotide
  Description of Combined DNA/RNA Molecule: Synthetic oligonucleotide
ccuuucuccaggaccaauatt

SEQ ID NO: 588 - DNA, 21 bp, Artificial Sequence
  Description of Artificial Sequence: Synthetic oligonucleotide
  Description of Combined DNA/RNA Molecule: Synthetic oligonucleotide
cuuucuccaggaccaauaatt

SEQ ID NO: 589 - DNA, 21 bp, Artificial Sequence
  Description of Artificial Sequence: Synthetic oligonucleotide
  Description of Combined DNA/RNA Molecule: Synthetic oligonucleotide
uuucuccaggaccaauaaatt

SEQ ID NO: 590 - DNA, 21 bp, Artificial Sequence
  Description of Artificial Sequence: Synthetic oligonucleotide
  Description of Combined DNA/RNA Molecule: Synthetic oligonucleotide
uucuccaggaccaauaaaatt

SEQ ID NO: 591 - DNA, 21 bp, Artificial Sequence
  Description of Artificial Sequence: Synthetic oligonucleotide
  Description of Combined DNA/RNA Molecule: Synthetic oligonucleotide
ucuccaggaccaauaaaautt

SEQ ID NO: 592 - DNA, 21 bp, Artificial Sequence
  Description of Artificial Sequence: Synthetic oligonucleotide
  Description of Combined DNA/RNA Molecule: Synthetic oligonucleotide
cuccaggaccaauaaaauutt

SEQ ID NO: 593 - DNA, 21 bp, Artificial Sequence
  Description of Artificial Sequence: Synthetic oligonucleotide
  Description of Combined DNA/RNA Molecule: Synthetic oligonucleotide
uccaggaccaauaaaauuutt

SEQ ID NO: 594 - DNA, 21 bp, Artificial Sequence
  Description of Artificial Sequence: Synthetic oligonucleotide
  Description of Combined DNA/RNA Molecule: Synthetic oligonucleotide
ccaggaccaauaaaauuuctt

SEQ ID NO: 595 - DNA, 21 bp, Artificial Sequence
  Description of Artificial Sequence: Synthetic oligonucleotide
  Description of Combined DNA/RNA Molecule: Synthetic oligonucleotide
caggaccaauaaaauuucutt

SEQ ID NO: 596 - DNA, 21 bp, Artificial Sequence
  Description of Artificial Sequence: Synthetic oligonucleotide
  Description of Combined DNA/RNA Molecule: Synthetic oligonucleotide
aggaccaauaaaauuucuatt

SEQ ID NO: 597 - DNA, 21 bp, Artificial Sequence
  Description of Artificial Sequence: Synthetic oligonucleotide
  Description of Combined DNA/RNA Molecule: Synthetic oligonucleotide
ggaccaauaaaauuucuaatt

SEQ ID NO: 598 - DNA, 21 bp, Artificial Sequence
  Description of Artificial Sequence: Synthetic oligonucleotide
  Description of Combined DNA/RNA Molecule: Synthetic oligonucleotide
gaccaauaaaauuucuaagtt

SEQ ID NO: 599 - DNA, 21 bp, Artificial Sequence
  Description of Artificial Sequence: Synthetic oligonucleotide
  Description of Combined DNA/RNA Molecule: Synthetic oligonucleotide
accaauaaaauuucuaagatt

SEQ ID NO: 600 - DNA, 21 bp, Artificial Sequence
  Description of Artificial Sequence: Synthetic oligonucleotide
  Description of Combined DNA/RNA Molecule: Synthetic oligonucleotide
ccaauaaaauuucuaagagtt

SEQ ID NO: 601 - DNA, 21 bp, Artificial Sequence
  Description of Artificial Sequence: Synthetic oligonucleotide
  Description of Combined DNA/RNA Molecule: Synthetic oligonucleotide
caauaaaauuucuaagagatt

SEQ ID NO: 602 - DNA, 21 bp, Artificial Sequence
  Description of Artificial Sequence: Synthetic oligonucleotide
  Description of Combined DNA/RNA Molecule: Synthetic oligonucleotide
aauaaaauuucuaagagagtt

SEQ ID NO: 603 - DNA, 21 bp, Artificial Sequence
  Description of Artificial Sequence: Synthetic oligonucleotide
  Description of Combined DNA/RNA Molecule: Synthetic oligonucleotide
auaaaauuucuaagagagctt

SEQ ID NO: 604 - DNA, 21 bp, Artificial Sequence
  Description of Artificial Sequence: Synthetic oligonucleotide
  Description of Combined DNA/RNA Molecule: Synthetic oligonucleotide
uaaaauuucuaagagagcutt

SEQ ID NO: 605 - DNA, 21 bp, Artificial Sequence
  Description of Artificial Sequence: Synthetic oligonucleotide
  Description of Combined DNA/RNA Molecule: Synthetic oligonucleotide
aaaauuucuaagagagcuatt

SEQ ID NO: 606 - DNA, 21 bp, Artificial Sequence
  Description of Artificial Sequence: Synthetic oligonucleotide
  Description of Combined DNA/RNA Molecule: Synthetic oligonucleotide
aaauuucuaagagagcuaatt

SEQ ID NO: 607 - DNA, 21 bp, Artificial Sequence
  Description of Artificial Sequence: Synthetic oligonucleotide
  Description of Combined DNA/RNA Molecule: Synthetic oligonucleotide
aauuucuaagagagcuaaatt

SEQ ID NO: 608 - DNA, 21 bp, Artificial Sequence
  Description of Artificial Sequence: Synthetic oligonucleotide
  Description of Combined DNA/RNA Molecule: Synthetic oligonucleotide
auuucuaagagagcuaaaatt

SEQ ID NO: 609 - DNA, 21 bp, Artificial Sequence
  Description of Artificial Sequence: Synthetic oligonucleotide
  Description of Combined DNA/RNA Molecule: Synthetic oligonucleotide
ugguggcgaagacugcggcgg

SEQ ID NO: 610 - DNA, 21 bp, Artificial Sequence
  Description of Artificial Sequence: Synthetic oligonucleotide
  Description of Combined DNA/RNA Molecule: Synthetic oligonucleotide
augguggcgaagacugcggcg

SEQ ID NO: 611 - DNA, 21 bp, Artificial Sequence
  Description of Artificial Sequence: Synthetic oligonucleotide
  Description of Combined DNA/RNA Molecule: Synthetic oligonucleotide
caugguggcgaagacugcggc

SEQ ID NO: 612 - DNA, 21 bp, Artificial Sequence
  Description of Artificial Sequence: Synthetic oligonucleotide
  Description of Combined DNA/RNA Molecule: Synthetic oligonucleotide
gcaugguggcgaagacugcgg

SEQ ID NO: 613 - DNA, 21 bp, Artificial Sequence
  Description of Artificial Sequence: Synthetic oligonucleotide
  Description of Combined DNA/RNA Molecule: Synthetic oligonucleotide
ggcaugguggcgaagacugcg

SEQ ID NO: 614 - DNA, 21 bp, Artificial Sequence
  Description of Artificial Sequence: Synthetic oligonucleotide
  Description of Combined DNA/RNA Molecule: Synthetic oligonucleotide
cggcaugguggcgaagacugc

SEQ ID NO: 615 - DNA, 21 bp, Artificial Sequence
  Description of Artificial Sequence: Synthetic oligonucleotide
  Description of Combined DNA/RNA Molecule: Synthetic oligonucleotide
gcggcaugguggcgaagactg

SEQ ID NO: 616 - DNA, 21 bp, Artificial Sequence
  Description of Artificial Sequence: Synthetic oligonucleotide
  Description of Combined DNA/RNA Molecule: Synthetic oligonucleotide
ggcggcaugguggcgaagact

SEQ ID NO: 617 - DNA, 21 bp, Artificial Sequence
  Description of Artificial Sequence: Synthetic oligonucleotide
  Description of Combined DNA/RNA Molecule: Synthetic oligonucleotide
gggcggcaugguggcgaagac

SEQ ID NO: 618 - DNA, 21 bp, Artificial Sequence
  Description of Artificial Sequence: Synthetic oligonucleotide
  Description of Combined DNA/RNA Molecule: Synthetic oligonucleotide
agggcggcaugguggcgaaga

SEQ ID NO: 619 - DNA, 21 bp, Artificial Sequence
  Description of Artificial Sequence: Synthetic oligonucleotide
  Description of Combined DNA/RNA Molecule: Synthetic oligonucleotide
uagggcggcaugguggcgaag

SEQ ID NO: 620 - DNA, 21 bp, Artificial Sequence
  Description of Artificial Sequence: Synthetic oligonucleotide
  Description of Combined DNA/RNA Molecule: Synthetic oligonucleotide
guagggcggcaugguggcgaa

SEQ ID NO: 621 - DNA, 21 bp, Artificial Sequence
  Description of Artificial Sequence: Synthetic oligonucleotide
  Description of Combined DNA/RNA Molecule: Synthetic oligonucleotide
uguagggcggcaugguggcga

SEQ ID NO: 622 - DNA, 21 bp, Artificial Sequence
  Description of Artificial Sequence: Synthetic oligonucleotide
  Description of Combined DNA/RNA Molecule: Synthetic oligonucleotide
guguagggcggcaugguggcg

SEQ ID NO: 623 - DNA, 21 bp, Artificial Sequence
  Description of Artificial Sequence: Synthetic oligonucleotide
  Description of Combined DNA/RNA Molecule: Synthetic oligonucleotide
gguguagggcggcaugguggc

SEQ ID NO: 624 - DNA, 21 bp, Artificial Sequence
  Description of Artificial Sequence: Synthetic oligonucleotide
  Description of Combined DNA/RNA Molecule: Synthetic oligonucleotide
cgguguagggcggcauggugg

SEQ ID NO: 625 - DNA, 21 bp, Artificial Sequence
  Description of Artificial Sequence: Synthetic oligonucleotide
  Description of Combined DNA/RNA Molecule: Synthetic oligonucleotide
acgguguagggcggcauggtg

SEQ ID NO: 626 - DNA, 21 bp, Artificial Sequence
  Description of Artificial Sequence: Synthetic oligonucleotide
  Description of Combined DNA/RNA Molecule: Synthetic oligonucleotide
cacgguguagggcggcauggt

SEQ ID NO: 627 - DNA, 21 bp, Artificial Sequence
  Description of Artificial Sequence: Synthetic oligonucleotide
  Description of Combined DNA/RNA Molecule: Synthetic oligonucleotide
ccacgguguagggcggcaugg

SEQ ID NO: 628 - DNA, 21 bp, Artificial Sequence
  Description of Artificial Sequence: Synthetic oligonucleotide
  Description of Combined DNA/RNA Molecule: Synthetic oligonucleotide
accacgguguagggcggcatg

SEQ ID NO: 629 - DNA, 21 bp, Artificial Sequence
  Description of Artificial Sequence: Synthetic oligonucleotide
  Description of Combined DNA/RNA Molecule: Synthetic oligonucleotide
gaccacgguguagggcggcat

SEQ ID NO: 630 - DNA, 21 bp, Artificial Sequence
  Description of Artificial Sequence: Synthetic oligonucleotide
  Description of Combined DNA/RNA Molecule: Synthetic oligonucleotide
agaccacgguguagggcggca

SEQ ID NO: 631 - DNA, 21 bp, Artificial Sequence
  Description of Artificial Sequence: Synthetic oligonucleotide
  Description of Combined DNA/RNA Molecule: Synthetic oligonucleotide
uagaccacgguguagggcggc

SEQ ID NO: 632 - DNA, 21 bp, Artificial Sequence
  Description of Artificial Sequence: Synthetic oligonucleotide
  Description of Combined DNA/RNA Molecule: Synthetic oligonucleotide
auagaccacgguguagggcgg

SEQ ID NO: 633 - DNA, 21 bp, Artificial Sequence
  Description of Artificial Sequence: Synthetic oligonucleotide
  Description of Combined DNA/RNA Molecule: Synthetic oligonucleotide
aauagaccacgguguagggcg

SEQ ID NO: 634 - DNA, 21 bp, Artificial Sequence
  Description of Artificial Sequence: Synthetic oligonucleotide
  Description of Combined DNA/RNA Molecule: Synthetic oligonucleotide
aaauagaccacgguguagggc

SEQ ID NO: 635 - DNA, 21 bp, Artificial Sequence
  Description of Artificial Sequence: Synthetic oligonucleotide
  Description of Combined DNA/RNA Molecule: Synthetic oligonucleotide
gaaauagaccacgguguaggg

SEQ ID NO: 636 - DNA, 21 bp, Artificial Sequence
  Description of Artificial Sequence: Synthetic oligonucleotide
  Description of Combined DNA/RNA Molecule: Synthetic oligonucleotide
ggaaauagaccacgguguagg

SEQ ID NO: 637 - DNA, 21 bp, Artificial Sequence
  Description of Artificial Sequence: Synthetic oligonucleotide
  Description of Combined DNA/RNA Molecule: Synthetic oligonucleotide
gggaaauagaccacgguguag

SEQ ID NO: 638 - DNA, 21 bp, Artificial Sequence
  Description of Artificial Sequence: Synthetic oligonucleotide
  Description of Combined DNA/RNA Molecule: Synthetic oligonucleotide
ugggaaauagaccacggugta

SEQ ID NO: 639 - DNA, 21 bp, Artificial Sequence
  Description of Artificial Sequence: Synthetic oligonucleotide
  Description of Combined DNA/RNA Molecule: Synthetic oligonucleotide
cugggaaauagaccacggugt

SEQ ID NO: 640 - DNA, 21 bp, Artificial Sequence
  Description of Artificial Sequence: Synthetic oligonucleotide
  Description of Combined DNA/RNA Molecule: Synthetic oligonucleotide
acugggaaauagaccacggtg

SEQ ID NO: 641 - DNA, 21 bp, Artificial Sequence
  Description of Artificial Sequence: Synthetic oligonucleotide
  Description of Combined DNA/RNA Molecule: Synthetic oligonucleotide
aacugggaaauagaccacggt

SEQ ID NO: 642 - DNA, 21 bp, Artificial Sequence
  Description of Artificial Sequence: Synthetic oligonucleotide
  Description of Combined DNA/RNA Molecule: Synthetic oligonucleotide
gaacugggaaauagaccacgg

SEQ ID NO: 643 - DNA, 21 bp, Artificial Sequence
  Description of Artificial Sequence: Synthetic oligonucleotide
  Description of Combined DNA/RNA Molecule: Synthetic oligonucleotide
cgaacugggaaauagaccacg

SEQ ID NO: 644 - DNA, 21 bp, Artificial Sequence
  Description of Artificial Sequence: Synthetic oligonucleotide
  Description of Combined DNA/RNA Molecule: Synthetic oligonucleotide
ucgaacugggaaauagaccac

SEQ ID NO: 645 - DNA, 21 bp, Artificial Sequence
  Description of Artificial Sequence: Synthetic oligonucleotide
  Description of Combined DNA/RNA Molecule: Synthetic oligonucleotide
cucgaacugggaaauagacca

SEQ ID NO: 646 - DNA, 21 bp, Artificial Sequence
  Description of Artificial Sequence: Synthetic oligonucleotide
  Description of Combined DNA/RNA Molecule: Synthetic oligonucleotide
ccucgaacugggaaauagacc

SEQ ID NO: 647 - DNA, 21 bp, Artificial Sequence
  Description of Artificial Sequence: Synthetic oligonucleotide
  Description of Combined DNA/RNA Molecule: Synthetic oligonucleotide
gccucgaacugggaaauagac

SEQ ID NO: 648 - DNA, 21 bp, Artificial Sequence
  Description of Artificial Sequence: Synthetic oligonucleotide
  Description of Combined DNA/RNA Molecule: Synthetic oligonucleotide
ggccucgaacugggaaauaga

SEQ ID NO: 649 - DNA, 21 bp, Artificial Sequence
  Description of Artificial Sequence: Synthetic oligonucleotide
  Description of Combined DNA/RNA Molecule: Synthetic oligonucleotide
cggccucgaacugggaaauag

SEQ ID NO: 650 - DNA, 21 bp, Artificial Sequence
  Description of Artificial Sequence: Synthetic oligonucleotide
  Description of Combined DNA/RNA Molecule: Synthetic oligonucleotide
gcggccucgaacugggaaata

SEQ ID NO: 651 - DNA, 21 bp, Artificial Sequence
  Description of Artificial Sequence: Synthetic oligonucleotide
  Description of Combined DNA/RNA Molecule: Synthetic oligonucleotide
agcggccucgaacugggaaat

SEQ ID NO: 652 - DNA, 21 bp, Artificial Sequence
  Description of Artificial Sequence: Synthetic oligonucleotide
  Description of Combined DNA/RNA Molecule: Synthetic oligonucleotide
cagcggccucgaacugggaaa

SEQ ID NO: 653 - DNA, 21 bp, Artificial Sequence
  Description of Artificial Sequence: Synthetic oligonucleotide
  Description of Combined DNA/RNA Molecule: Synthetic oligonucleotide
gcagcggccucgaacugggaa

SEQ ID NO: 654 - DNA, 21 bp, Artificial Sequence
  Description of Artificial Sequence: Synthetic oligonucleotide
  Description of Combined DNA/RNA Molecule: Synthetic oligonucleotide
cgcagcggccucgaacuggga

SEQ ID NO: 655 - DNA, 21 bp, Artificial Sequence
  Description of Artificial Sequence: Synthetic oligonucleotide
  Description of Combined DNA/RNA Molecule: Synthetic oligonucleotide
gcgcagcggccucgaacuggg

SEQ ID NO: 656 - DNA, 21 bp, Artificial Sequence
  Description of Artificial Sequence: Synthetic oligonucleotide
  Description of Combined DNA/RNA Molecule: Synthetic oligonucleotide
cgcgcagcggccucgaacugg

SEQ ID NO: 657 - DNA, 21 bp, Artificial Sequence
  Description of Artificial Sequence: Synthetic oligonucleotide
  Description of Combined DNA/RNA Molecule: Synthetic oligonucleotide
ccgcgcagcggccucgaactg

SEQ ID NO: 658 - DNA, 21 bp, Artificial Sequence
  Description of Artificial Sequence: Synthetic oligonucleotide
  Description of Combined DNA/RNA Molecule: Synthetic oligonucleotide
gccgcgcagcggccucgaact

SEQ ID NO: 659 - DNA, 21 bp, Artificial Sequence
  Description of Artificial Sequence: Synthetic oligonucleotide
  Description of Combined DNA/RNA Molecule: Synthetic oligonucleotide
ggccgcgcagcggccucgaac

SEQ ID NO: 660 - DNA, 21 bp, Artificial Sequence
  Description of Artificial Sequence: Synthetic oligonucleotide
  Description of Combined DNA/RNA Molecule: Synthetic oligonucleotide
gggccgcgcagcggccucgaa

SEQ ID NO: 661 - DNA, 21 bp, Artificial Sequence
  Description of Artificial Sequence: Synthetic oligonucleotide
  Description of Combined DNA/RNA Molecule: Synthetic oligonucleotide
agggccgcgcagcggccucga

SEQ ID NO: 662 - DNA, 21 bp, Artificial Sequence
  Description of Artificial Sequence: Synthetic oligonucleotide
  Description of Combined DNA/RNA Molecule: Synthetic oligonucleotide
cagggccgcgcagcggccucg

SEQ ID NO: 663 - DNA, 21 bp, Artificial Sequence
  Description of Artificial Sequence: Synthetic oligonucleotide
  Description of Combined DNA/RNA Molecule: Synthetic oligonucleotide
gcagggccgcgcagcggcctc

SEQ ID NO: 664 - DNA, 21 bp, Artificial Sequence
  Description of Artificial Sequence: Synthetic oligonucleotide
  Description of Combined DNA/RNA Molecule: Synthetic oligonucleotide
cgcagggccgcgcagcggcct

SEQ ID NO: 665 - DNA, 21 bp, Artificial Sequence
  Description of Artificial Sequence: Synthetic oligonucleotide
  Description of Combined DNA/RNA Molecule: Synthetic oligonucleotide
gcgcagggccgcgcagcggcc

SEQ ID NO: 666 - DNA, 21 bp, Artificial Sequence
  Description of Artificial Sequence: Synthetic oligonucleotide
  Description of Combined DNA/RNA Molecule: Synthetic oligonucleotide
ugcgcagggccgcgcagcggc

SEQ ID NO: 667 - DNA, 21 bp, Artificial Sequence
  Description of Artificial Sequence: Synthetic oligonucleotide
  Description of Combined DNA/RNA Molecule: Synthetic oligonucleotide
augcgcagggccgcgcagcgg

SEQ ID NO: 668 - DNA, 21 bp, Artificial Sequence
  Description of Artificial Sequence: Synthetic oligonucleotide
  Description of Combined DNA/RNA Molecule: Synthetic oligonucleotide
caugcgcagggccgcgcagcg

SEQ ID NO: 669 - DNA, 21 bp, Artificial Sequence
  Description of Artificial Sequence: Synthetic oligonucleotide
  Description of Combined DNA/RNA Molecule: Synthetic oligonucleotide
gcaugcgcagggccgcgcagc

SEQ ID NO: 670 - DNA, 21 bp, Artificial Sequence
  Description of Artificial Sequence: Synthetic oligonucleotide
  Description of Combined DNA/RNA Molecule: Synthetic oligonucleotide
agcaugcgcagggccgcgcag

SEQ ID NO: 671 - DNA, 21 bp, Artificial Sequence
  Description of Artificial Sequence: Synthetic oligonucleotide
  Description of Combined DNA/RNA Molecule: Synthetic oligonucleotide
cagcaugcgcagggccgcgca

SEQ ID NO: 672 - DNA, 21 bp, Artificial Sequence
  Description of Artificial Sequence: Synthetic oligonucleotide
  Description of Combined DNA/RNA Molecule: Synthetic oligonucleotide
gcagcaugcgcagggccgcgc

SEQ ID NO: 673 - DNA, 21 bp, Artificial Sequence
  Description of Artificial Sequence: Synthetic oligonucleotide
  Description of Combined DNA/RNA Molecule: Synthetic oligonucleotide
agcagcaugcgcagggccgcg

SEQ ID NO: 674 - DNA, 21 bp, Artificial Sequence
  Description of Artificial Sequence: Synthetic oligonucleotide
  Description of Combined DNA/RNA Molecule: Synthetic oligonucleotide
cagcagcaugcgcagggccgc

SEQ ID NO: 675 - DNA, 21 bp, Artificial Sequence
  Description of Artificial Sequence: Synthetic oligonucleotide
  Description of Combined DNA/RNA Molecule: Synthetic oligonucleotide
ccagcagcaugcgcagggccg

SEQ ID NO: 676 - DNA, 21 bp, Artificial Sequence
  Description of Artificial Sequence: Synthetic oligonucleotide
  Description of Combined DNA/RNA Molecule: Synthetic oligonucleotide
gccagcagcaugcgcagggcc

SEQ ID NO: 677 - DNA, 21 bp, Artificial Sequence
  Description of Artificial Sequence: Synthetic oligonucleotide
  Description of Combined DNA/RNA Molecule: Synthetic oligonucleotide
ugccagcagcaugcgcagggc

SEQ ID NO: 678 - DNA, 21 bp, Artificial Sequence
  Description of Artificial Sequence: Synthetic oligonucleotide
  Description of Combined DNA/RNA Molecule: Synthetic oligonucleotide
cugccagcagcaugcgcaggg

SEQ ID NO: 679 - DNA, 21 bp, Artificial Sequence
  Description of Artificial Sequence: Synthetic oligonucleotide
  Description of Combined DNA/RNA Molecule: Synthetic oligonucleotide
ucugccagcagcaugcgcagg

SEQ ID NO: 680 - DNA, 21 bp, Artificial Sequence
  Description of Artificial Sequence: Synthetic oligonucleotide
  Description of Combined DNA/RNA Molecule: Synthetic oligonucleotide
aucugccagcagcaugcgcag

SEQ ID NO: 681 - DNA, 21 bp, Artificial Sequence
  Description of Artificial Sequence: Synthetic oligonucleotide
  Description of Combined DNA/RNA Molecule: Synthetic oligonucleotide
gaucugccagcagcaugcgca

SEQ ID NO: 682 - DNA, 21 bp, Artificial Sequence
  Description of Artificial Sequence: Synthetic oligonucleotide
  Description of Combined DNA/RNA Molecule: Synthetic oligonucleotide
ugaucugccagcagcaugcgc

SEQ ID NO: 683 - DNA, 21 bp, Artificial Sequence
  Description of Artificial Sequence: Synthetic oligonucleotide
  Description of Combined DNA/RNA Molecule: Synthetic oligonucleotide
cugaucugccagcagcaugcg

SEQ ID NO: 684 - DNA, 21 bp, Artificial Sequence
  Description of Artificial Sequence: Synthetic oligonucleotide
  Description of Combined DNA/RNA Molecule: Synthetic oligonucleotide
ccugaucugccagcagcaugc

SEQ ID NO: 685 - DNA, 21 bp, Artificial Sequence
  Description of Artificial Sequence: Synthetic oligonucleotide
  Description of Combined DNA/RNA Molecule: Synthetic oligonucleotide
cccugaucugccagcagcatg

SEQ ID NO: 686 - DNA, 21 bp, Artificial Sequence
  Description of Artificial Sequence: Synthetic oligonucleotide
  Description of Combined DNA/RNA Molecule: Synthetic oligonucleotide
gcccugaucugccagcagcat

SEQ ID NO: 687 - DNA, 21 bp, Artificial Sequence
  Description of Artificial Sequence: Synthetic oligonucleotide
  Description of Combined DNA/RNA Molecule: Synthetic oligonucleotide
ggcccugaucugccagcagca

SEQ ID NO: 688 - DNA, 21 bp, Artificial Sequence
  Description of Artificial Sequence: Synthetic oligonucleotide
  Description of Combined DNA/RNA Molecule: Synthetic oligonucleotide
uggcccugaucugccagcagc

SEQ ID NO: 689 - DNA, 21 bp, Artificial Sequence
  Description of Artificial Sequence: Synthetic oligonucleotide
  Description of Combined DNA/RNA Molecule: Synthetic oligonucleotide
cuggcccugaucugccagcag

SEQ ID NO: 690 - DNA, 21 bp, Artificial Sequence
  Description of Artificial Sequence: Synthetic oligonucleotide
  Description of Combined DNA/RNA Molecule: Synthetic oligonucleotide
ucuggcccugaucugccagca

SEQ ID NO: 691 - DNA, 21 bp, Artificial Sequence
  Description of Artificial Sequence: Synthetic oligonucleotide
  Description of Combined DNA/RNA Molecule: Synthetic oligonucleotide
cucuggcccugaucugccagc

SEQ ID NO: 692 - DNA, 21 bp, Artificial Sequence
  Description of Artificial Sequence: Synthetic oligonucleotide
  Description of Combined DNA/RNA Molecule: Synthetic oligonucleotide
gcucuggcccugaucugccag

SEQ ID NO: 693 - DNA, 21 bp, Artificial Sequence
  Description of Artificial Sequence: Synthetic oligonucleotide
  Description of Combined DNA/RNA Molecule: Synthetic oligonucleotide
agcucuggcccugaucugcca

SEQ ID NO: 694 - DNA, 21 bp, Artificial Sequence
  Description of Artificial Sequence: Synthetic oligonucleotide
  Description of Combined DNA/RNA Molecule: Synthetic oligonucleotide
cagcucuggcccugaucugcc

SEQ ID NO: 695 - DNA, 21 bp, Artificial Sequence
  Description of Artificial Sequence: Synthetic oligonucleotide
  Description of Combined DNA/RNA Molecule: Synthetic oligonucleotide
ccagcucuggcccugaucugc

SEQ ID NO: 696 - DNA, 21 bp, Artificial Sequence
  Description of Artificial Sequence: Synthetic oligonucleotide
  Description of Combined DNA/RNA Molecule: Synthetic oligonucleotide
uccagcucuggcccugauctg

SEQ ID NO: 697 - DNA, 21 bp, Artificial Sequence
  Description of Artificial Sequence: Synthetic oligonucleotide
  Description of Combined DNA/RNA Molecule: Synthetic oligonucleotide
uuccagcucuggcccugauct

SEQ ID NO: 698 - DNA, 21 bp, Artificial Sequence
  Description of Artificial Sequence: Synthetic oligonucleotide
  Description of Combined DNA/RNA Molecule: Synthetic oligonucleotide
cuuccagcucuggcccugatc

SEQ ID NO: 699 - DNA, 21 bp, Artificial Sequence
  Description of Artificial Sequence: Synthetic oligonucleotide
  Description of Combined DNA/RNA Molecule: Synthetic oligonucleotide
ccuuccagcucuggcccugat

SEQ ID NO: 700 - DNA, 21 bp, Artificial Sequence
  Description of Artificial Sequence: Synthetic oligonucleotide
  Description of Combined DNA/RNA Molecule: Synthetic oligonucleotide
uccuuccagcucuggcccuga

SEQ ID NO: 701 - DNA, 21 bp, Artificial Sequence
  Description of Artificial Sequence: Synthetic oligonucleotide
  Description of Combined DNA/RNA Molecule: Synthetic oligonucleotide
cuccuuccagcucuggccctg

SEQ ID NO: 702 - DNA, 21 bp, Artificial Sequence
  Description of Artificial Sequence: Synthetic oligonucleotide
  Description of Combined DNA/RNA Molecule: Synthetic oligonucleotide
ccuccuuccagcucuggccct

SEQ ID NO: 703 - DNA, 21 bp, Artificial Sequence
  Description of Artificial Sequence: Synthetic oligonucleotide
  Description of Combined DNA/RNA Molecule: Synthetic oligonucleotide
uccuccuuccagcucuggccc

SEQ ID NO: 704 - DNA, 21 bp, Artificial Sequence
  Description of Artificial Sequence: Synthetic oligonucleotide
  Description of Combined DNA/RNA Molecule: Synthetic oligonucleotide
cuccuccuuccagcucuggcc

SEQ ID NO: 705 - DNA, 21 bp, Artificial Sequence
  Description of Artificial Sequence: Synthetic oligonucleotide
  Description of Combined DNA/RNA Molecule: Synthetic oligonucleotide
ccuccuccuuccagcucuggc

SEQ ID NO: 706 - DNA, 21 bp, Artificial Sequence
  Description of Artificial Sequence: Synthetic oligonucleotide
  Description of Combined DNA/RNA Molecule: Synthetic oligonucleotide
accuccuccuuccagcucugg

SEQ ID NO: 707 - DNA, 21 bp, Artificial Sequence
  Description of Artificial Sequence: Synthetic oligonucleotide
  Description of Combined DNA/RNA Molecule: Synthetic oligonucleotide
caccuccuccuuccagcuctg

SEQ ID NO: 708 - DNA, 21 bp, Artificial Sequence
  Description of Artificial Sequence: Synthetic oligonucleotide
  Description of Combined DNA/RNA Molecule: Synthetic oligonucleotide
uaccuccuccuuccagcuctg

SEQ ID NO: 709 - DNA, 21 bp, Artificial Sequence
  Description of Artificial Sequence: Synthetic oligonucleotide
  Description of Combined DNA/RNA Molecule: Synthetic oligonucleotide
ccaccuccuccuuccagcuct

SEQ ID NO: 710 - DNA, 21 bp, Artificial Sequence
  Description of Artificial Sequence: Synthetic oligonucleotide
  Description of Combined DNA/RNA Molecule: Synthetic oligonucleotide
accaccuccuccuuccagctc

SEQ ID NO: 711 - DNA, 21 bp, Artificial Sequence
  Description of Artificial Sequence: Synthetic oligonucleotide
  Description of Combined DNA/RNA Molecule: Synthetic oligonucleotide
caccaccuccuccuuccagct

SEQ ID NO: 712 - DNA, 21 bp, Artificial Sequence
  Description of Artificial Sequence: Synthetic oligonucleotide
  Description of Combined DNA/RNA Molecule: Synthetic oligonucleotide
ucaccaccuccuccuuccagc

SEQ ID NO: 713 - DNA, 21 bp, Artificial Sequence
  Description of Artificial Sequence: Synthetic oligonucleotide
  Description of Combined DNA/RNA Molecule: Synthetic oligonucleotide
gucaccaccuccuccuuccag

SEQ ID NO: 714 - DNA, 21 bp, Artificial Sequence
  Description of Artificial Sequence: Synthetic oligonucleotide
  Description of Combined DNA/RNA Molecule: Synthetic oligonucleotide
ggucaccaccuccuccuucca

SEQ ID NO: 715 - DNA, 21 bp, Artificial Sequence
  Description of Artificial Sequence: Synthetic oligonucleotide
  Description of Combined DNA/RNA Molecule: Synthetic oligonucleotide
cggucaccaccuccuccuucc

SEQ ID NO: 716 - DNA, 21 bp, Artificial Sequence
  Description of Artificial Sequence: Synthetic oligonucleotide
  Description of Combined DNA/RNA Molecule: Synthetic oligonucleotide
acggucaccaccuccuccutc

SEQ ID NO: 717 - DNA, 21 bp, Artificial Sequence
  Description of Artificial Sequence: Synthetic oligonucleotide
  Description of Combined DNA/RNA Molecule: Synthetic oligonucleotide
cacggucaccaccuccucctt

SEQ ID NO: 718 - DNA, 21 bp, Artificial Sequence
  Description of Artificial Sequence: Synthetic oligonucleotide
  Description of Combined DNA/RNA Molecule: Synthetic oligonucleotide
ccacggucaccaccuccucct

SEQ ID NO: 719 - DNA, 21 bp, Artificial Sequence
  Description of Artificial Sequence: Synthetic oligonucleotide
  Description of Combined DNA/RNA Molecule: Synthetic oligonucleotide
uccacggucaccaccuccucc

SEQ ID NO: 720 - DNA, 21 bp, Artificial Sequence
  Description of Artificial Sequence: Synthetic oligonucleotide
  Description of Combined DNA/RNA Molecule: Synthetic oligonucleotide
cuccacggucaccaccucctc

SEQ ID NO: 721 - DNA, 21 bp, Artificial Sequence
  Description of Artificial Sequence: Synthetic oligonucleotide
  Description of Combined DNA/RNA Molecule: Synthetic oligonucleotide
ucuccacggucaccaccucct

SEQ ID NO: 722 - DNA, 21 bp, Artificial Sequence
  Description of Artificial Sequence: Synthetic oligonucleotide
  Description of Combined DNA/RNA Molecule: Synthetic oligonucleotide
gucuccacggucaccaccucc

SEQ ID NO: 723 - DNA, 21 bp, Artificial Sequence
  Description of Artificial Sequence: Synthetic oligonucleotide
  Description of Combined DNA/RNA Molecule: Synthetic oligonucleotide
cgucuccacggucaccacctc

SEQ ID NO: 724 - DNA, 21 bp, Artificial Sequence
  Description of Artificial Sequence: Synthetic oligonucleotide
  Description of Combined DNA/RNA Molecule: Synthetic oligonucleotide
acgucuccacggucaccacct

SEQ ID NO: 725 - DNA, 21 bp, Artificial Sequence
  Description of Artificial Sequence: Synthetic oligonucleotide
  Description of Combined DNA/RNA Molecule: Synthetic oligonucleotide
cacgucuccacggucaccacc

SEQ ID NO: 726 - DNA, 21 bp, Artificial Sequence
  Description of Artificial Sequence: Synthetic oligonucleotide
  Description of Combined DNA/RNA Molecule: Synthetic oligonucleotide
ccacgucuccacggucaccac

SEQ ID NO: 727 - DNA, 21 bp, Artificial Sequence
  Description of Artificial Sequence: Synthetic oligonucleotide
  Description of Combined DNA/RNA Molecule: Synthetic oligonucleotide
gccacgucuccacggucacca

SEQ ID NO: 728 - DNA, 21 bp, Artificial Sequence
  Description of Artificial Sequence: Synthetic oligonucleotide
  Description of Combined DNA/RNA Molecule: Synthetic oligonucleotide
ugccacgucuccacggucacc

SEQ ID NO: 729 - DNA, 21 bp, Artificial Sequence
  Description of Artificial Sequence: Synthetic oligonucleotide
  Description of Combined DNA/RNA Molecule: Synthetic oligonucleotide
cugccacgucuccacggucac

SEQ ID NO: 730 - DNA, 21 bp, Artificial Sequence
  Description of Artificial Sequence: Synthetic oligonucleotide
  Description of Combined DNA/RNA Molecule: Synthetic oligonucleotide
ccugccacgucuccacgguca

SEQ ID NO: 731 - DNA, 21 bp, Artificial Sequence
  Description of Artificial Sequence: Synthetic oligonucleotide
  Description of Combined DNA/RNA Molecule: Synthetic oligonucleotide
uccugccacgucuccacggtc

SEQ ID NO: 732 - DNA, 21 bp, Artificial Sequence
  Description of Artificial Sequence: Synthetic oligonucleotide
  Description of Combined DNA/RNA Molecule: Synthetic oligonucleotide
cuccugccacgucuccacggt

SEQ ID NO: 733 - DNA, 21 bp, Artificial Sequence
  Description of Artificial Sequence: Synthetic oligonucleotide
  Description of Combined DNA/RNA Molecule: Synthetic oligonucleotide
ccuccugccacgucuccacgg

SEQ ID NO: 734 - DNA, 21 bp, Artificial Sequence
  Description of Artificial Sequence: Synthetic oligonucleotide
  Description of Combined DNA/RNA Molecule: Synthetic oligonucleotide
cccuccugccacgucuccacg

SEQ ID NO: 735 - DNA, 21 bp, Artificial Sequence
  Description of Artificial Sequence: Synthetic oligonucleotide
  Description of Combined DNA/RNA Molecule: Synthetic oligonucleotide
gcccuccugccacgucuccac

SEQ ID NO: 736 - DNA, 21 bp, Artificial Sequence
  Description of Artificial Sequence: Synthetic oligonucleotide
  Description of Combined DNA/RNA Molecule: Synthetic oligonucleotide
agcccuccugccacgucucca

SEQ ID NO: 737 - DNA, 21 bp, Artificial Sequence
  Description of Artificial Sequence: Synthetic oligonucleotide
  Description of Combined DNA/RNA Molecule: Synthetic oligonucleotide
gagcccuccugccacgucucc

SEQ ID NO: 738 - DNA, 21 bp, Artificial Sequence
  Description of Artificial Sequence: Synthetic oligonucleotide
  Description of Combined DNA/RNA Molecule: Synthetic oligonucleotide
ugagcccuccugccacguctc

SEQ ID NO: 739 - DNA, 21 bp, Artificial Sequence
  Description of Artificial Sequence: Synthetic oligonucleotide
  Description of Combined DNA/RNA Molecule: Synthetic oligonucleotide
gugagcccuccugccacguct

SEQ ID NO: 740 - DNA, 21 bp, Artificial Sequence
  Description of Artificial Sequence: Synthetic oligonucleotide
  Description of Combined DNA/RNA Molecule: Synthetic oligonucleotide
agugagcccuccugccacgtc

SEQ ID NO: 741 - DNA, 21 bp, Artificial Sequence
  Description of Artificial Sequence: Synthetic oligonucleotide
  Description of Combined DNA/RNA Molecule: Synthetic oligonucleotide
gagugagcccuccugccacgt

SEQ ID NO: 742 - DNA, 21 bp, Artificial Sequence
  Description of Artificial Sequence: Synthetic oligonucleotide
  Description of Combined DNA/RNA Molecule: Synthetic oligonucleotide
ugagugagcccuccugccacg

SEQ ID NO: 743 - DNA, 21 bp, Artificial Sequence
  Description of Artificial Sequence: Synthetic oligonucleotide
  Description of Combined DNA/RNA Molecule: Synthetic oligonucleotide
uugagugagcccuccugccac

SEQ ID NO: 744 - DNA, 21 bp, Artificial Sequence
  Description of Artificial Sequence: Synthetic oligonucleotide
  Description of Combined DNA/RNA Molecule: Synthetic oligonucleotide
uuugagugagcccuccugcca

SEQ ID NO: 745 - DNA, 21 bp, Artificial Sequence
  Description of Artificial Sequence: Synthetic oligonucleotide
  Description of Combined DNA/RNA Molecule: Synthetic oligonucleotide
cuuugagugagcccuccugcc

SEQ ID NO: 746 - DNA, 21 bp, Artificial Sequence
  Description of Artificial Sequence: Synthetic oligonucleotide
  Description of Combined DNA/RNA Molecule: Synthetic oligonucleotide
gcuuugagugagcccuccugc

SEQ ID NO: 747 - DNA, 21 bp, Artificial Sequence
  Description of Artificial Sequence: Synthetic oligonucleotide
  Description of Combined DNA/RNA Molecule: Synthetic oligonucleotide
ggcuuugagugagcccucctg

SEQ ID NO: 748 - DNA, 21 bp, Artificial Sequence
  Description of Artificial Sequence: Synthetic oligonucleotide
  Description of Combined DNA/RNA Molecule: Synthetic oligonucleotide
aggcuuugagugagcccucct

SEQ ID NO: 749 - DNA, 21 bp, Artificial Sequence
  Description of Artificial Sequence: Synthetic oligonucleotide
  Description of Combined DNA/RNA Molecule: Synthetic oligonucleotide
gaggcuuugagugagcccucc

SEQ ID NO: 750 - DNA, 21 bp, Artificial Sequence
  Description of Artificial Sequence: Synthetic oligonucleotide
  Description of Combined DNA/RNA Molecule: Synthetic oligonucleotide
ggaggcuuugagugagccctc

SEQ ID NO: 751 - DNA, 21 bp, Artificial Sequence
  Description of Artificial Sequence: Synthetic oligonucleotide
  Description of Combined DNA/RNA Molecule: Synthetic oligonucleotide
aggaggcuuugagugagccct

SEQ ID NO: 752 - DNA, 21 bp, Artificial Sequence
  Description of Artificial Sequence: Synthetic oligonucleotide
  Description of Combined DNA/RNA Molecule: Synthetic oligonucleotide
caggaggcuuugagugagccc

SEQ ID NO: 753 - DNA, 21 bp, Artificial Sequence
  Description of Artificial Sequence: Synthetic oligonucleotide
  Description of Combined DNA/RNA Molecule: Synthetic oligonucleotide
gcaggaggcuuugagugagcc

SEQ ID NO: 754 - DNA, 21 bp, Artificial Sequence
  Description of Artificial Sequence: Synthetic oligonucleotide
  Description of Combined DNA/RNA Molecule: Synthetic oligonucleotide
ggcaggaggcuuugagugagc

SEQ ID NO: 755 - DNA, 21 bp, Artificial Sequence
  Description of Artificial Sequence: Synthetic oligonucleotide
  Description of Combined DNA/RNA Molecule: Synthetic oligonucleotide
aggcaggaggcuuugagugag

SEQ ID NO: 756 - DNA, 21 bp, Artificial Sequence
  Description of Artificial Sequence: Synthetic oligonucleotide
  Description of Combined DNA/RNA Molecule: Synthetic oligonucleotide
uaggcaggaggcuuugaguga

SEQ ID NO: 757 - DNA, 21 bp, Artificial Sequence
  Description of Artificial Sequence: Synthetic oligonucleotide
  Description of Combined DNA/RNA Molecule: Synthetic oligonucleotide
auaggcaggaggcuuugagtg

SEQ ID NO: 758 - DNA, 21 bp, Artificial Sequence
  Description of Artificial Sequence: Synthetic oligonucleotide
  Description of Combined DNA/RNA Molecule: Synthetic oligonucleotide
uauaggcaggaggcuuugagt

SEQ ID NO: 759 - DNA, 21 bp, Artificial Sequence
  Description of Artificial Sequence: Synthetic oligonucleotide
  Description of Combined DNA/RNA Molecule: Synthetic oligonucleotide
guauaggcaggaggcuuugag

SEQ ID NO: 760 - DNA, 21 bp, Artificial Sequence
  Description of Artificial Sequence: Synthetic oligonucleotide
  Description of Combined DNA/RNA Molecule: Synthetic oligonucleotide
cguauaggcaggaggcuuuga

SEQ ID NO: 761 - DNA, 21 bp, Artificial Sequence
  Description of Artificial Sequence: Synthetic oligonucleotide
  Description of Combined DNA/RNA Molecule: Synthetic oligonucleotide
ccguauaggcaggaggcuutg

SEQ ID NO: 762 - DNA, 21 bp, Artificial Sequence
  Description of Artificial Sequence: Synthetic oligonucleotide
  Description of Combined DNA/RNA Molecule: Synthetic oligonucleotide
cccguauaggcaggaggcutt

SEQ ID NO: 763 - DNA, 21 bp, Artificial Sequence
  Description of Artificial Sequence: Synthetic oligonucleotide
  Description of Combined DNA/RNA Molecule: Synthetic oligonucleotide
gcccguauaggcaggaggctt

SEQ ID NO: 764 - DNA, 21 bp, Artificial Sequence
  Description of Artificial Sequence: Synthetic oligonucleotide
  Description of Combined DNA/RNA Molecule: Synthetic oligonucleotide
ugcccguauaggcaggaggct

SEQ ID NO: 765 - DNA, 21 bp, Artificial Sequence
  Description of Artificial Sequence: Synthetic oligonucleotide
  Description of Combined DNA/RNA Molecule: Synthetic oligonucleotide
cugcccguauaggcaggaggc

SEQ ID NO: 766 - DNA, 21 bp, Artificial Sequence
  Description of Artificial Sequence: Synthetic oligonucleotide
  Description of Combined DNA/RNA Molecule: Synthetic oligonucleotide
gcugcccguauaggcaggagg

SEQ ID NO: 767 - DNA, 21 bp, Artificial Sequence
  Description of Artificial Sequence: Synthetic oligonucleotide
  Description of Combined DNA/RNA Molecule: Synthetic oligonucleotide
agcugcccguauaggcaggag

SEQ ID NO: 768 - DNA, 21 bp, Artificial Sequence
  Description of Artificial Sequence: Synthetic oligonucleotide
  Description of Combined DNA/RNA Molecule: Synthetic oligonucleotide
gagcugcccguauaggcagga

SEQ ID NO: 769 - DNA, 21 bp, Artificial Sequence
  Description of Artificial Sequence: Synthetic oligonucleotide
  Description of Combined DNA/RNA Molecule: Synthetic oligonucleotide
ggagcugcccguauaggcagg

SEQ ID NO: 770 - DNA, 21 bp, Artificial Sequence
  Description of Artificial Sequence: Synthetic oligonucleotide
  Description of Combined DNA/RNA Molecule: Synthetic oligonucleotide
gggagcugcccguauaggcag

SEQ ID NO: 771 - DNA, 21 bp, Artificial Sequence
  Description of Artificial Sequence: Synthetic oligonucleotide
  Description of Combined DNA/RNA Molecule: Synthetic oligonucleotide
cuccguccuggaacuugggga

SEQ ID NO: 772 - DNA, 21 bp, Artificial Sequence
  Description of Artificial Sequence: Synthetic oligonucleotide
  Description of Combined DNA/RNA Molecule: Synthetic oligonucleotide
ucuccguccuggaacuugggg

SEQ ID NO: 773 - DNA, 21 bp, Artificial Sequence
  Description of Artificial Sequence: Synthetic oligonucleotide
  Description of Combined DNA/RNA Molecule: Synthetic oligonucleotide
gucuccguccuggaacuuggg

SEQ ID NO: 774 - DNA, 21 bp, Artificial Sequence
  Description of Artificial Sequence: Synthetic oligonucleotide
  Description of Combined DNA/RNA Molecule: Synthetic oligonucleotide
ggucuccguccuggaacuugg

SEQ ID NO: 775 - DNA, 21 bp, Artificial Sequence
  Description of Artificial Sequence: Synthetic oligonucleotide
  Description of Combined DNA/RNA Molecule: Synthetic oligonucleotide
aggucuccguccuggaacutg

SEQ ID NO: 776 - DNA, 21 bp, Artificial Sequence
  Description of Artificial Sequence: Synthetic oligonucleotide
  Description of Combined DNA/RNA Molecule: Synthetic oligonucleotide
gaggucuccguccuggaactt

SEQ ID NO: 777 - DNA, 21 bp, Artificial Sequence
  Description of Artificial Sequence: Synthetic oligonucleotide
  Description of Combined DNA/RNA Molecule: Synthetic oligonucleotide
ugaggucuccguccuggaact

SEQ ID NO: 778 - DNA, 21 bp, Artificial Sequence
  Description of Artificial Sequence: Synthetic oligonucleotide
  Description of Combined DNA/RNA Molecule: Synthetic oligonucleotide
gugaggucuccguccuggaac

SEQ ID NO: 779 - DNA, 21 bp, Artificial Sequence
  Description of Artificial Sequence: Synthetic oligonucleotide
  Description of Combined DNA/RNA Molecule: Synthetic oligonucleotide
ggugaggucuccguccuggaa

SEQ ID NO: 780 - DNA, 21 bp, Artificial Sequence
  Description of Artificial Sequence: Synthetic oligonucleotide
  Description of Combined DNA/RNA Molecule: Synthetic oligonucleotide
gggugaggucuccguccugga

SEQ ID NO: 781 - DNA, 21 bp, Artificial Sequence
  Description of Artificial Sequence: Synthetic oligonucleotide
  Description of Combined DNA/RNA Molecule: Synthetic oligonucleotide
agggugaggucuccguccugg

SEQ ID NO: 782 - DNA, 21 bp, Artificial Sequence
  Description of Artificial Sequence: Synthetic oligonucleotide
  Description of Combined DNA/RNA Molecule: Synthetic oligonucleotide
cagggugaggucuccgucctg

SEQ ID NO: 783 - DNA, 21 bp, Artificial Sequence
  Description of Artificial Sequence: Synthetic oligonucleotide
  Description of Combined DNA/RNA Molecule: Synthetic oligonucleotide
acagggugaggucuccgucct

SEQ ID NO: 784 - DNA, 21 bp, Artificial Sequence
  Description of Artificial Sequence: Synthetic oligonucleotide
  Description of Combined DNA/RNA Molecule: Synthetic oligonucleotide
uacagggugaggucuccgucc

SEQ ID NO: 785 - DNA, 21 bp, Artificial Sequence
  Description of Artificial Sequence: Synthetic oligonucleotide
  Description of Combined DNA/RNA Molecule: Synthetic oligonucleotide
guacagggugaggucuccgtc

SEQ ID NO: 786 - DNA, 21 bp, Artificial Sequence
  Description of Artificial Sequence: Synthetic oligonucleotide
  Description of Combined DNA/RNA Molecule: Synthetic oligonucleotide
gguacagggugaggucuccgt

SEQ ID NO: 787 - DNA, 21 bp, Artificial Sequence
  Description of Artificial Sequence: Synthetic oligonucleotide
  Description of Combined DNA/RNA Molecule: Synthetic oligonucleotide
ugguacagggugaggucuccg

SEQ ID NO: 788 - DNA, 21 bp, Artificial Sequence
  Description of Artificial Sequence: Synthetic oligonucleotide
  Description of Combined DNA/RNA Molecule: Synthetic oligonucleotide
cugguacagggugaggucucc

SEQ ID NO: 789 - DNA, 21 bp, Artificial Sequence
  Description of Artificial Sequence: Synthetic oligonucleotide
  Description of Combined DNA/RNA Molecule: Synthetic oligonucleotide
acugguacagggugagguctc

SEQ ID NO: 790 - DNA, 21 bp, Artificial Sequence
  Description of Artificial Sequence: Synthetic oligonucleotide
  Description of Combined DNA/RNA Molecule: Synthetic oligonucleotide
gacugguacagggugagguct

SEQ ID NO: 791 - DNA, 21 bp, Artificial Sequence
  Description of Artificial Sequence: Synthetic oligonucleotide
  Description of Combined DNA/RNA Molecule: Synthetic oligonucleotide
ggacugguacagggugaggtc

SEQ ID NO: 792 - DNA, 21 bp, Artificial Sequence
  Description of Artificial Sequence: Synthetic oligonucleotide
  Description of Combined DNA/RNA Molecule: Synthetic oligonucleotide
uggacugguacagggugaggt

SEQ ID NO: 793 - DNA, 21 bp, Artificial Sequence
  Description of Artificial Sequence: Synthetic oligonucleotide
  Description of Combined DNA/RNA Molecule: Synthetic oligonucleotide
uuggacugguacagggugagg

SEQ ID NO: 794 - DNA, 21 bp, Artificial Sequence
  Description of Artificial Sequence: Synthetic oligonucleotide
  Description of Combined DNA/RNA Molecule: Synthetic oligonucleotide
auuggacugguacagggugag

SEQ ID NO: 795 - DNA, 21 bp, Artificial Sequence
  Description of Artificial Sequence: Synthetic oligonucleotide
  Description of Combined DNA/RNA Molecule: Synthetic oligonucleotide
uauuggacugguacaggguga

SEQ ID NO: 796 - DNA, 21 bp, Artificial Sequence
  Description of Artificial Sequence: Synthetic oligonucleotide
  Description of Combined DNA/RNA Molecule: Synthetic oligonucleotide
guauuggacugguacagggtg

SEQ ID NO: 797 - DNA, 21 bp, Artificial Sequence
  Description of Artificial Sequence: Synthetic oligonucleotide
  Description of Combined DNA/RNA Molecule: Synthetic oligonucleotide
gguauuggacugguacagggt

SEQ ID NO: 798 - DNA, 21 bp, Artificial Sequence
  Description of Artificial Sequence: Synthetic oligonucleotide
  Description of Combined DNA/RNA Molecule: Synthetic oligonucleotide
ugguauuggacugguacaggg

SEQ ID NO: 799 - DNA, 21 bp, Artificial Sequence
  Description of Artificial Sequence: Synthetic oligonucleotide
  Description of Combined DNA/RNA Molecule: Synthetic oligonucleotide
augguauuggacugguacagg

SEQ ID NO: 800 - DNA, 21 bp, Artificial Sequence
  Description of Artificial Sequence: Synthetic oligonucleotide
  Description of Combined DNA/RNA Molecule: Synthetic oligonucleotide
gaugguauuggacugguacag

SEQ ID NO: 801 - DNA, 21 bp, Artificial Sequence
  Description of Artificial Sequence: Synthetic oligonucleotide
  Description of Combined DNA/RNA Molecule: Synthetic oligonucleotide
ggaugguauuggacugguaca

SEQ ID NO: 802 - DNA, 21 bp, Artificial Sequence
  Description of Artificial Sequence: Synthetic oligonucleotide
  Description of Combined DNA/RNA Molecule: Synthetic oligonucleotide
aggaugguauuggacugguac

SEQ ID NO: 803 - DNA, 21 bp, Artificial Sequence
  Description of Artificial Sequence: Synthetic oligonucleotide
  Description of Combined DNA/RNA Molecule: Synthetic oligonucleotide
caggaugguauuggacuggta

SEQ ID NO: 804 - DNA, 21 bp, Artificial Sequence
  Description of Artificial Sequence: Synthetic oligonucleotide
  Description of Combined DNA/RNA Molecule: Synthetic oligonucleotide
gcaggaugguauuggacuggt

SEQ ID NO: 805 - DNA, 21 bp, Artificial Sequence
  Description of Artificial Sequence: Synthetic oligonucleotide
  Description of Combined DNA/RNA Molecule: Synthetic oligonucleotide
cgcaggaugguauuggacugg

SEQ ID NO: 806 - DNA, 21 bp, Artificial Sequence
  Description of Artificial Sequence: Synthetic oligonucleotide
  Description of Combined DNA/RNA Molecule: Synthetic oligonucleotide
acgcaggaugguauuggactg

SEQ ID NO: 807 - DNA, 21 bp, Artificial Sequence
  Description of Artificial Sequence: Synthetic oligonucleotide
  Description of Combined DNA/RNA Molecule: Synthetic oligonucleotide
gacgcaggaugguauuggact

SEQ ID NO: 808 - DNA, 21 bp, Artificial Sequence
  Description of Artificial Sequence: Synthetic oligonucleotide
  Description of Combined DNA/RNA Molecule: Synthetic oligonucleotide
ugacgcaggaugguauuggac

SEQ ID NO: 809 - DNA, 21 bp, Artificial Sequence
  Description of Artificial Sequence: Synthetic oligonucleotide
  Description of Combined DNA/RNA Molecule: Synthetic oligonucleotide
gugacgcaggaugguauugga

SEQ ID NO: 810 - DNA, 21 bp, Artificial Sequence
  Description of Artificial Sequence: Synthetic oligonucleotide
  Description of Combined DNA/RNA Molecule: Synthetic oligonucleotide
ggugacgcaggaugguauugg

SEQ ID NO: 811 - DNA, 21 bp, Artificial Sequence
  Description of Artificial Sequence: Synthetic oligonucleotide
  Description of Combined DNA/RNA Molecule: Synthetic oligonucleotide
aggugacgcaggaugguautg

SEQ ID NO: 812 - DNA, 21 bp, Artificial Sequence
  Description of Artificial Sequence: Synthetic oligonucleotide
  Description of Combined DNA/RNA Molecule: Synthetic oligonucleotide
caggugacgcaggaugguatt

SEQ ID NO: 813 - DNA, 21 bp, Artificial Sequence
  Description of Artificial Sequence: Synthetic oligonucleotide
  Description of Combined DNA/RNA Molecule: Synthetic oligonucleotide
ccaggugacgcaggaugguat

SEQ ID NO: 814 - DNA, 21 bp, Artificial Sequence
  Description of Artificial Sequence: Synthetic oligonucleotide
  Description of Combined DNA/RNA Molecule: Synthetic oligonucleotide
cccaggugacgcaggauggta

SEQ ID NO: 815 - DNA, 21 bp, Artificial Sequence
  Description of Artificial Sequence: Synthetic oligonucleotide
  Description of Combined DNA/RNA Molecule: Synthetic oligonucleotide
gcccaggugacgcaggauggt

SEQ ID NO: 816 - DNA, 21 bp, Artificial Sequence
  Description of Artificial Sequence: Synthetic oligonucleotide
  Description of Combined DNA/RNA Molecule: Synthetic oligonucleotide
ggcccaggugacgcaggaugg

SEQ ID NO: 817 - DNA, 21 bp, Artificial Sequence
  Description of Artificial Sequence: Synthetic oligonucleotide
  Description of Combined DNA/RNA Molecule: Synthetic oligonucleotide
cggcccaggugacgcaggatg

SEQ ID NO: 818 - DNA, 21 bp, Artificial Sequence
  Description of Artificial Sequence: Synthetic oligonucleotide
  Description of Combined DNA/RNA Molecule: Synthetic oligonucleotide
gcggcccaggugacgcaggat

SEQ ID NO: 819 - DNA, 21 bp, Artificial Sequence
  Description of Artificial Sequence: Synthetic oligonucleotide
  Description of Combined DNA/RNA Molecule: Synthetic oligonucleotide
ugcggcccaggugacgcagga

SEQ ID NO: 820 - DNA, 21 bp, Artificial Sequence
  Description of Artificial Sequence: Synthetic oligonucleotide
  Description of Combined DNA/RNA Molecule: Synthetic oligonucleotide
gugcggcccaggugacgcagg

SEQ ID NO: 821 - DNA, 21 bp, Artificial Sequence
  Description of Artificial Sequence: Synthetic oligonucleotide
  Description of Combined DNA/RNA Molecule: Synthetic oligonucleotide
ggugcggcccaggugacgcag

SEQ ID NO: 822 - DNA, 21 bp, Artificial Sequence
  Description of Artificial Sequence: Synthetic oligonucleotide
  Description of Combined DNA/RNA Molecule: Synthetic oligonucleotide
gggugcggcccaggugacgca

SEQ ID NO: 823 - DNA, 21 bp, Artificial Sequence
  Description of Artificial Sequence: Synthetic oligonucleotide
  Description of Combined DNA/RNA Molecule: Synthetic oligonucleotide
agggugcggcccaggugacgc

SEQ ID NO: 824 - DNA, 21 bp, Artificial Sequence
  Description of Artificial Sequence: Synthetic oligonucleotide
  Description of Combined DNA/RNA Molecule: Synthetic oligonucleotide
aagggugcggcccaggugacg

SEQ ID NO: 825 - DNA, 21 bp, Artificial Sequence
  Description of Artificial Sequence: Synthetic oligonucleotide
  Description of Combined DNA/RNA Molecule: Synthetic oligonucleotide
caagggugcggcccaggugac

SEQ ID NO: 826 - DNA, 21 bp, Artificial Sequence
  Description of Artificial Sequence: Synthetic oligonucleotide
  Description of Combined DNA/RNA Molecule: Synthetic oligonucleotide
ccaagggugcggcccagguga

SEQ ID NO: 827 - DNA, 21 bp, Artificial Sequence
  Description of Artificial Sequence: Synthetic oligonucleotide
  Description of Combined DNA/RNA Molecule: Synthetic oligonucleotide
cccaagggugcggcccaggtg

SEQ ID NO: 828 - DNA, 21 bp, Artificial Sequence
  Description of Artificial Sequence: Synthetic oligonucleotide
  Description of Combined DNA/RNA Molecule: Synthetic oligonucleotide
gcccaagggugcggcccaggt

SEQ ID NO: 829 - DNA, 21 bp, Artificial Sequence
  Description of Artificial Sequence: Synthetic oligonucleotide
  Description of Combined DNA/RNA Molecule: Synthetic oligonucleotide
agcccaagggugcggcccagg

SEQ ID NO: 830 - DNA, 21 bp, Artificial Sequence
  Description of Artificial Sequence: Synthetic oligonucleotide
  Description of Combined DNA/RNA Molecule: Synthetic oligonucleotide
gagcccaagggugcggcccag

SEQ ID NO: 831 - DNA, 21 bp, Artificial Sequence
  Description of Artificial Sequence: Synthetic oligonucleotide
  Description of Combined DNA/RNA Molecule: Synthetic oligonucleotide
agagcccaagggugcggccca

SEQ ID NO: 832 - DNA, 21 bp, Artificial Sequence
  Description of Artificial Sequence: Synthetic oligonucleotide
  Description of Combined DNA/RNA Molecule: Synthetic oligonucleotide
uagagcccaagggugcggccc

SEQ ID NO: 833 - DNA, 21 bp, Artificial Sequence
  Description of Artificial Sequence: Synthetic oligonucleotide
  Description of Combined DNA/RNA Molecule: Synthetic oligonucleotide
auagagcccaagggugcggcc

SEQ ID NO: 834 - DNA, 21 bp, Artificial Sequence
  Description of Artificial Sequence: Synthetic oligonucleotide
  Description of Combined DNA/RNA Molecule: Synthetic oligonucleotide
cauagagcccaagggugcggc

SEQ ID NO: 835 - DNA, 21 bp, Artificial Sequence
  Description of Artificial Sequence: Synthetic oligonucleotide
  Description of Combined DNA/RNA Molecule: Synthetic oligonucleotide
ccauagagcccaagggugcgg

SEQ ID NO: 836 - DNA, 21 bp, Artificial Sequence
  Description of Artificial Sequence: Synthetic oligonucleotide
  Description of Combined DNA/RNA Molecule: Synthetic oligonucleotide
cccauagagcccaagggugcg

SEQ ID NO: 837 - DNA, 21 bp, Artificial Sequence
  Description of Artificial Sequence: Synthetic oligonucleotide
  Description of Combined DNA/RNA Molecule: Synthetic oligonucleotide
ucccauagagcccaagggugc

SEQ ID NO: 838 - DNA, 21 bp, Artificial Sequence
  Description of Artificial Sequence: Synthetic oligonucleotide
  Description of Combined DNA/RNA Molecule: Synthetic oligonucleotide
uucccauagagcccaagggtg

SEQ ID NO: 839 - DNA, 21 bp, Artificial Sequence
  Description of Artificial Sequence: Synthetic oligonucleotide
  Description of Combined DNA/RNA Molecule: Synthetic oligonucleotide
cuucccauagagcccaagggt

SEQ ID NO: 840 - DNA, 21 bp, Artificial Sequence
  Description of Artificial Sequence: Synthetic oligonucleotide
  Description of Combined DNA/RNA Molecule: Synthetic oligonucleotide
ccuucccauagagcccaaggg

SEQ ID NO: 841 - DNA, 21 bp, Artificial Sequence
  Description of Artificial Sequence: Synthetic oligonucleotide
  Description of Combined DNA/RNA Molecule: Synthetic oligonucleotide
uccuucccauagagcccaagg

SEQ ID NO: 842 - DNA, 21 bp, Artificial Sequence
  Description of Artificial Sequence: Synthetic oligonucleotide
  Description of Combined DNA/RNA Molecule: Synthetic oligonucleotide
guccuucccauagagcccaag

SEQ ID NO: 843 - DNA, 21 bp, Artificial Sequence
  Description of Artificial Sequence: Synthetic oligonucleotide
  Description of Combined DNA/RNA Molecule: Synthetic oligonucleotide
gguccuucccauagagcccaa

SEQ ID NO: 844 - DNA, 21 bp, Artificial Sequence
  Description of Artificial Sequence: Synthetic oligonucleotide
  Description of Combined DNA/RNA Molecule: Synthetic oligonucleotide
ugguccuucccauagagccca

SEQ ID NO: 845 - DNA, 21 bp, Artificial Sequence
  Description of Artificial Sequence: Synthetic oligonucleotide
  Description of Combined DNA/RNA Molecule: Synthetic oligonucleotide
cugguccuucccauagagccc

SEQ ID NO: 846 - DNA, 21 bp, Artificial Sequence
  Description of Artificial Sequence: Synthetic oligonucleotide
  Description of Combined DNA/RNA Molecule: Synthetic oligonucleotide
gcugguccuucccauagagcc

SEQ ID NO: 847 - DNA, 21 bp, Artificial Sequence
  Description of Artificial Sequence: Synthetic oligonucleotide
  Description of Combined DNA/RNA Molecule: Synthetic oligonucleotide
ugcugguccuucccauagagc

SEQ ID NO: 848 - DNA, 21 bp, Artificial Sequence
  Description of Artificial Sequence: Synthetic oligonucleotide
  Description of Combined DNA/RNA Molecule: Synthetic oligonucleotide
cugcugguccuucccauagag

SEQ ID NO: 849 - DNA, 21 bp, Artificial Sequence
  Description of Artificial Sequence: Synthetic oligonucleotide
  Description of Combined DNA/RNA Molecule: Synthetic oligonucleotide
ccugcugguccuucccauaga

SEQ ID NO: 850 - DNA, 21 bp, Artificial Sequence
  Description of Artificial Sequence: Synthetic oligonucleotide
  Description of Combined DNA/RNA Molecule: Synthetic oligonucleotide
uccugcugguccuucccauag

SEQ ID NO: 851 - DNA, 21 bp, Artificial Sequence
  Description of Artificial Sequence: Synthetic oligonucleotide
  Description of Combined DNA/RNA Molecule: Synthetic oligonucleotide
cuccugcugguccuucccata

SEQ ID NO: 852 - DNA, 21 bp, Artificial Sequence
  Description of Artificial Sequence: Synthetic oligonucleotide
  Description of Combined DNA/RNA Molecule: Synthetic oligonucleotide
ccuccugcugguccuucccat

SEQ ID NO: 853 - DNA, 21 bp, Artificial Sequence
  Description of Artificial Sequence: Synthetic oligonucleotide
  Description of Combined DNA/RNA Molecule: Synthetic oligonucleotide
gccuccugcugguccuuccca

SEQ ID NO: 854 - DNA, 21 bp, Artificial Sequence
  Description of Artificial Sequence: Synthetic oligonucleotide
  Description of Combined DNA/RNA Molecule: Synthetic oligonucleotide
ugccuccugcugguccuuccc

SEQ ID NO: 855 - DNA, 21 bp, Artificial Sequence
  Description of Artificial Sequence: Synthetic oligonucleotide
  Description of Combined DNA/RNA Molecule: Synthetic oligonucleotide
cugccuccugcugguccuucc

SEQ ID NO: 856 - DNA, 21 bp, Artificial Sequence
  Description of Artificial Sequence: Synthetic oligonucleotide
  Description of Combined DNA/RNA Molecule: Synthetic oligonucleotide
gcugccuccugcugguccutc

SEQ ID NO: 857 - DNA, 21 bp, Artificial Sequence
  Description of Artificial Sequence: Synthetic oligonucleotide
  Description of Combined DNA/RNA Molecule: Synthetic oligonucleotide
ggcugccuccugcuggucctt

SEQ ID NO: 858 - DNA, 21 bp, Artificial Sequence
  Description of Artificial Sequence: Synthetic oligonucleotide
  Description of Combined DNA/RNA Molecule: Synthetic oligonucleotide
gggcugccuccugcuggucct

SEQ ID NO: 859 - DNA, 21 bp, Artificial Sequence
  Description of Artificial Sequence: Synthetic oligonucleotide
  Description of Combined DNA/RNA Molecule: Synthetic oligonucleotide
agggcugccuccugcuggucc

SEQ ID NO: 860 - DNA, 21 bp, Artificial Sequence
  Description of Artificial Sequence: Synthetic oligonucleotide
  Description of Combined DNA/RNA Molecule: Synthetic oligonucleotide
cagggcugccuccugcuggtc

SEQ ID NO: 861 - DNA, 21 bp, Artificial Sequence
  Description of Artificial Sequence: Synthetic oligonucleotide
  Description of Combined DNA/RNA Molecule: Synthetic oligonucleotide
ccagggcugccuccugcuggt

SEQ ID NO: 862 - DNA, 21 bp, Artificial Sequence
  Description of Artificial Sequence: Synthetic oligonucleotide
  Description of Combined DNA/RNA Molecule: Synthetic oligonucleotide
accagggcugccuccugcugg

SEQ ID NO: 863 - DNA, 21 bp, Artificial Sequence
  Description of Artificial Sequence: Synthetic oligonucleotide
  Description of Combined DNA/RNA Molecule: Synthetic oligonucleotide
caccagggcugccuccugctg

SEQ ID NO: 864 - DNA, 21 bp, Artificial Sequence
  Description of Artificial Sequence: Synthetic oligonucleotide
  Description of Combined DNA/RNA Molecule: Synthetic oligonucleotide
ccaccagggcugccuccugct

SEQ ID NO: 865 - DNA, 21 bp, Artificial Sequence
  Description of Artificial Sequence: Synthetic oligonucleotide
  Description of Combined DNA/RNA Molecule: Synthetic oligonucleotide
uccaccagggcugccuccugc

SEQ ID NO: 866 - DNA, 21 bp, Artificial Sequence
  Description of Artificial Sequence: Synthetic oligonucleotide
  Description of Combined DNA/RNA Molecule: Synthetic oligonucleotide
guccaccagggcugccucctg

SEQ ID NO: 867 - DNA, 21 bp, Artificial Sequence
  Description of Artificial Sequence: Synthetic oligonucleotide
  Description of Combined DNA/RNA Molecule: Synthetic oligonucleotide
uguccaccagggcugccucct

SEQ ID NO: 868 - DNA, 21 bp, Artificial Sequence
  Description of Artificial Sequence: Synthetic oligonucleotide
  Description of Combined DNA/RNA Molecule: Synthetic oligonucleotide
auguccaccagggcugccucc

SEQ ID NO: 869 - DNA, 21 bp, Artificial Sequence
  Description of Artificial Sequence: Synthetic oligonucleotide
  Description of Combined DNA/RNA Molecule: Synthetic oligonucleotide
cauguccaccagggcugcctc

SEQ ID NO: 870 - DNA, 21 bp, Artificial Sequence
  Description of Artificial Sequence: Synthetic oligonucleotide
  Description of Combined DNA/RNA Molecule: Synthetic oligonucleotide
ccauguccaccagggcugcct

SEQ ID NO: 871 - DNA, 21 bp, Artificial Sequence
  Description of Artificial Sequence: Synthetic oligonucleotide
  Description of Combined DNA/RNA Molecule: Synthetic oligonucleotide
accauguccaccagggcugcc

SEQ ID NO: 872 - DNA, 21 bp, Artificial Sequence
  Description of Artificial Sequence: Synthetic oligonucleotide
  Description of Combined DNA/RNA Molecule: Synthetic oligonucleotide
caccauguccaccagggcugc

SEQ ID NO: 873 - DNA, 21 bp, Artificial Sequence
  Description of Artificial Sequence: Synthetic oligonucleotide
  Description of Combined DNA/RNA Molecule: Synthetic oligonucleotide
ucaccauguccaccagggctg

SEQ ID NO: 874 - DNA, 21 bp, Artificial Sequence
  Description of Artificial Sequence: Synthetic oligonucleotide
  Description of Combined DNA/RNA Molecule: Synthetic oligonucleotide
uucaccauguccaccagggct

SEQ ID NO: 875 - DNA, 21 bp, Artificial Sequence
  Description of Artificial Sequence: Synthetic oligonucleotide
  Description of Combined DNA/RNA Molecule: Synthetic oligonucleotide
auucaccauguccaccagggc

SEQ ID NO: 876 - DNA, 21 bp, Artificial Sequence
  Description of Artificial Sequence: Synthetic oligonucleotide
  Description of Combined DNA/RNA Molecule: Synthetic oligonucleotide
cauucaccauguccaccaggg

SEQ ID NO: 877 - DNA, 21 bp, Artificial Sequence
  Description of Artificial Sequence: Synthetic oligonucleotide
  Description of Combined DNA/RNA Molecule: Synthetic oligonucleotide
ucauucaccauguccaccagg

SEQ ID NO: 878 - DNA, 21 bp, Artificial Sequence
  Description of Artificial Sequence: Synthetic oligonucleotide
  Description of Combined DNA/RNA Molecule: Synthetic oligonucleotide
gucauucaccauguccaccag

SEQ ID NO: 879 - DNA, 21 bp, Artificial Sequence
  Description of Artificial Sequence: Synthetic oligonucleotide
  Description of Combined DNA/RNA Molecule: Synthetic oligonucleotide
cgucauucaccauguccacca

SEQ ID NO: 880 - DNA, 21 bp, Artificial Sequence
  Description of Artificial Sequence: Synthetic oligonucleotide
  Description of Combined DNA/RNA Molecule: Synthetic oligonucleotide
ccgucauucaccauguccacc

SEQ ID NO: 881 - DNA, 21 bp, Artificial Sequence
  Description of Artificial Sequence: Synthetic oligonucleotide
  Description of Combined DNA/RNA Molecule: Synthetic oligonucleotide
gccgucauucaccauguccac

SEQ ID NO: 882 - DNA, 21 bp, Artificial Sequence
  Description of Artificial Sequence: Synthetic oligonucleotide
  Description of Combined DNA/RNA Molecule: Synthetic oligonucleotide
cgccgucauucaccaugucca

SEQ ID NO: 883 - DNA, 21 bp, Artificial Sequence
  Description of Artificial Sequence: Synthetic oligonucleotide
  Description of Combined DNA/RNA Molecule: Synthetic oligonucleotide
acgccgucauucaccaugucc

SEQ ID NO: 884 - DNA, 21 bp, Artificial Sequence
  Description of Artificial Sequence: Synthetic oligonucleotide
  Description of Combined DNA/RNA Molecule: Synthetic oligonucleotide
cacgccgucauucaccaugtc

SEQ ID NO: 885 - DNA, 21 bp, Artificial Sequence
  Description of Artificial Sequence: Synthetic oligonucleotide
  Description of Combined DNA/RNA Molecule: Synthetic oligonucleotide
ccacgccgucauucaccaugt

SEQ ID NO: 886 - DNA, 21 bp, Artificial Sequence
  Description of Artificial Sequence: Synthetic oligonucleotide
  Description of Combined DNA/RNA Molecule: Synthetic oligonucleotide
uccacgccgucauucaccatg

SEQ ID NO: 887 - DNA, 21 bp, Artificial Sequence
  Description of Artificial Sequence: Synthetic oligonucleotide
  Description of Combined DNA/RNA Molecule: Synthetic oligonucleotide
cuccacgccgucauucaccat

SEQ ID NO: 888 - DNA, 21 bp, Artificial Sequence
  Description of Artificial Sequence: Synthetic oligonucleotide
  Description of Combined DNA/RNA Molecule: Synthetic oligonucleotide
ccuccacgccgucauucacca

SEQ ID NO: 889 - DNA, 21 bp, Artificial Sequence
  Description of Artificial Sequence: Synthetic oligonucleotide
  Description of Combined DNA/RNA Molecule: Synthetic oligonucleotide
uccuccacgccgucauucacc

SEQ ID NO: 890 - DNA, 21 bp, Artificial Sequence
  Description of Artificial Sequence: Synthetic oligonucleotide
  Description of Combined DNA/RNA Molecule: Synthetic oligonucleotide
guccuccacgccgucauucac

SEQ ID NO: 891 - DNA, 21 bp, Artificial Sequence
  Description of Artificial Sequence: Synthetic oligonucleotide
  Description of Combined DNA/RNA Molecule: Synthetic oligonucleotide
gguccuccacgccgucauuca

SEQ ID NO: 892 - DNA, 21 bp, Artificial Sequence
  Description of Artificial Sequence: Synthetic oligonucleotide
  Description of Combined DNA/RNA Molecule: Synthetic oligonucleotide
agguccuccacgccgucautc

SEQ ID NO: 893 - DNA, 21 bp, Artificial Sequence
  Description of Artificial Sequence: Synthetic oligonucleotide
  Description of Combined DNA/RNA Molecule: Synthetic oligonucleotide
gagguccuccacgccgucatt

SEQ ID NO: 894 - DNA, 21 bp, Artificial Sequence
  Description of Artificial Sequence: Synthetic oligonucleotide
  Description of Combined DNA/RNA Molecule: Synthetic oligonucleotide
ggagguccuccacgccgucat

SEQ ID NO: 895 - DNA, 21 bp, Artificial Sequence
  Description of Artificial Sequence: Synthetic oligonucleotide
  Description of Combined DNA/RNA Molecule: Synthetic oligonucleotide
cggagguccuccacgccguca

SEQ ID NO: 896 - DNA, 21 bp, Artificial Sequence
  Description of Artificial Sequence: Synthetic oligonucleotide
  Description of Combined DNA/RNA Molecule: Synthetic oligonucleotide
gcggagguccuccacgccgtc

SEQ ID NO: 897 - DNA, 21 bp, Artificial Sequence
  Description of Artificial Sequence: Synthetic oligonucleotide
  Description of Combined DNA/RNA Molecule: Synthetic oligonucleotide
agcggagguccuccacgccgt

SEQ ID NO: 898 - DNA, 21 bp, Artificial Sequence
  Description of Artificial Sequence: Synthetic oligonucleotide
  Description of Combined DNA/RNA Molecule: Synthetic oligonucleotide
cagcggagguccuccacgccg

SEQ ID NO: 899 - DNA, 21 bp, Artificial Sequence
  Description of Artificial Sequence: Synthetic oligonucleotide
  Description of Combined DNA/RNA Molecule: Synthetic oligonucleotide
gcagcggagguccuccacgcc

SEQ ID NO: 900 - DNA, 21 bp, Artificial Sequence
  Description of Artificial Sequence: Synthetic oligonucleotide
  Description of Combined DNA/RNA Molecule: Synthetic oligonucleotide
ugcagcggagguccuccacgc

SEQ ID NO: 901 - DNA, 21 bp, Artificial Sequence
  Description of Artificial Sequence: Synthetic oligonucleotide
  Description of Combined DNA/RNA Molecule: Synthetic oligonucleotide
uugcagcggagguccuccacg

SEQ ID NO: 902 - DNA, 21 bp, Artificial Sequence
  Description of Artificial Sequence: Synthetic oligonucleotide
  Description of Combined DNA/RNA Molecule: Synthetic oligonucleotide
uuugcagcggagguccuccac

SEQ ID NO: 903 - DNA, 21 bp, Artificial Sequence
  Description of Artificial Sequence: Synthetic oligonucleotide
  Description of Combined DNA/RNA Molecule: Synthetic oligonucleotide
auuugcagcggagguccucca

SEQ ID NO: 904 - DNA, 21 bp, Artificial Sequence
  Description of Artificial Sequence: Synthetic oligonucleotide
  Description of Combined DNA/RNA Molecule: Synthetic oligonucleotide
uauuugcagcggagguccucc

SEQ ID NO: 905 - DNA, 21 bp, Artificial Sequence
  Description of Artificial Sequence: Synthetic oligonucleotide
  Description of Combined DNA/RNA Molecule: Synthetic oligonucleotide
guauuugcagcggaggucctc

SEQ ID NO: 906 - DNA, 21 bp, Artificial Sequence
  Description of Artificial Sequence: Synthetic oligonucleotide
  Description of Combined DNA/RNA Molecule: Synthetic oligonucleotide
uguauuugcagcggaggucct

SEQ ID NO: 907 - DNA, 21 bp, Artificial Sequence
  Description of Artificial Sequence: Synthetic oligonucleotide
  Description of Combined DNA/RNA Molecule: Synthetic oligonucleotide
auguauuugcagcggaggucc

SEQ ID NO: 908 - DNA, 21 bp, Artificial Sequence
  Description of Artificial Sequence: Synthetic oligonucleotide
  Description of Combined DNA/RNA Molecule: Synthetic oligonucleotide
gauguauuugcagcggaggtc

SEQ ID NO: 909 - DNA, 21 bp, Artificial Sequence
  Description of Artificial Sequence: Synthetic oligonucleotide
  Description of Combined DNA/RNA Molecule: Synthetic oligonucleotide
agauguauuugcagcggaggt

SEQ ID NO: 910 - DNA, 21 bp, Artificial Sequence
  Description of Artificial Sequence: Synthetic oligonucleotide
  Description of Combined DNA/RNA Molecule: Synthetic oligonucleotide
gagauguauuugcagcggagg

SEQ ID NO: 911 - DNA, 21 bp, Artificial Sequence
  Description of Artificial Sequence: Synthetic oligonucleotide
  Description of Combined DNA/RNA Molecule: Synthetic oligonucleotide
ggagauguauuugcagcggag

SEQ ID NO: 912 - DNA, 21 bp, Artificial Sequence
  Description of Artificial Sequence: Synthetic oligonucleotide
  Description of Combined DNA/RNA Molecule: Synthetic oligonucleotide
gggagauguauuugcagcgga

SEQ ID NO: 913 - DNA, 21 bp, Artificial Sequence
  Description of Artificial Sequence: Synthetic oligonucleotide
  Description of Combined DNA/RNA Molecule: Synthetic oligonucleotide
agggagauguauuugcagcgg

SEQ ID NO: 914 - DNA, 21 bp, Artificial Sequence
  Description of Artificial Sequence: Synthetic oligonucleotide
  Description of Combined DNA/RNA Molecule: Synthetic oligonucleotide
gagggagauguauuugcagcg

SEQ ID NO: 915 - DNA, 21 bp, Artificial Sequence
  Description of Artificial Sequence: Synthetic oligonucleotide
  Description of Combined DNA/RNA Molecule: Synthetic oligonucleotide
ugagggagauguauuugcagc

SEQ ID NO: 916 - DNA, 21 bp, Artificial Sequence
  Description of Artificial Sequence: Synthetic oligonucleotide
  Description of Combined DNA/RNA Molecule: Synthetic oligonucleotide
augagggagauguauuugcag

SEQ ID NO: 917 - DNA, 21 bp, Artificial Sequence
  Description of Artificial Sequence: Synthetic oligonucleotide
  Description of Combined DNA/RNA Molecule: Synthetic oligonucleotide
gaugagggagauguauuugca

SEQ ID NO: 918 - DNA, 21 bp, Artificial Sequence
  Description of Artificial Sequence: Synthetic oligonucleotide
  Description of Combined DNA/RNA Molecule: Synthetic oligonucleotide
agaugagggagauguauuugc

SEQ ID NO: 919 - DNA, 21 bp, Artificial Sequence
  Description of Artificial Sequence: Synthetic oligonucleotide
  Description of Combined DNA/RNA Molecule: Synthetic oligonucleotide
uagaugagggagauguauutg

SEQ ID NO: 920 - DNA, 21 bp, Artificial Sequence
  Description of Artificial Sequence: Synthetic oligonucleotide
  Description of Combined DNA/RNA Molecule: Synthetic oligonucleotide
guagaugagggagauguautt

SEQ ID NO: 921 - DNA, 21 bp, Artificial Sequence
  Description of Artificial Sequence: Synthetic oligonucleotide
  Description of Combined DNA/RNA Molecule: Synthetic oligonucleotide
uguagaugagggagauguatt

SEQ ID NO: 922 - DNA, 21 bp, Artificial Sequence
  Description of Artificial Sequence: Synthetic oligonucleotide
  Description of Combined DNA/RNA Molecule: Synthetic oligonucleotide
guguagaugagggagauguat

SEQ ID NO: 923 - DNA, 21 bp, Artificial Sequence
  Description of Artificial Sequence: Synthetic oligonucleotide
  Description of Combined DNA/RNA Molecule: Synthetic oligonucleotide
gguguagaugagggagaugta

SEQ ID NO: 924 - DNA, 21 bp, Artificial Sequence
  Description of Artificial Sequence: Synthetic oligonucleotide
  Description of Combined DNA/RNA Molecule: Synthetic oligonucleotide
ugguguagaugagggagaugt

SEQ ID NO: 925 - DNA, 21 bp, Artificial Sequence
  Description of Artificial Sequence: Synthetic oligonucleotide
  Description of Combined DNA/RNA Molecule: Synthetic oligonucleotide
uugguguagaugagggagatg

SEQ ID NO: 926 - DNA, 21 bp, Artificial Sequence
  Description of Artificial Sequence: Synthetic oligonucleotide
  Description of Combined DNA/RNA Molecule: Synthetic oligonucleotide
uugguguagaugagggagctg

SEQ ID NO: 927 - DNA, 21 bp, Artificial Sequence
  Description of Artificial Sequence: Synthetic oligonucleotide
  Description of Combined DNA/RNA Molecule: Synthetic oligonucleotide
guugguguagaugagggagat

SEQ ID NO: 928 - DNA, 21 bp, Artificial Sequence
  Description of Artificial Sequence: Synthetic oligonucleotide
  Description of Combined DNA/RNA Molecule: Synthetic oligonucleotide
aguugguguagaugagggaga

SEQ ID NO: 929 - DNA, 21 bp, Artificial Sequence
  Description of Artificial Sequence: Synthetic oligonucleotide
  Description of Combined DNA/RNA Molecule: Synthetic oligonucleotide
uuugguguagaugagggagat

SEQ ID NO: 930 - DNA, 21 bp, Artificial Sequence
  Description of Artificial Sequence: Synthetic oligonucleotide
  Description of Combined DNA/RNA Molecule: Synthetic oligonucleotide
uaguugguguagaugagggag

SEQ ID NO: 931 - DNA, 21 bp, Artificial Sequence
  Description of Artificial Sequence: Synthetic oligonucleotide
  Description of Combined DNA/RNA Molecule: Synthetic oligonucleotide
auaguugguguagaugaggga

SEQ ID NO: 932 - DNA, 21 bp, Artificial Sequence
  Description of Artificial Sequence: Synthetic oligonucleotide
  Description of Combined DNA/RNA Molecule: Synthetic oligonucleotide
uuaguugguguagaugaggga

SEQ ID NO: 933 - DNA, 21 bp, Artificial Sequence
  Description of Artificial Sequence: Synthetic oligonucleotide
  Description of Combined DNA/RNA Molecule: Synthetic oligonucleotide
cauaguugguguagaugaggg

SEQ ID NO: 934 - DNA, 21 bp, Artificial Sequence
  Description of Artificial Sequence: Synthetic oligonucleotide
  Description of Combined DNA/RNA Molecule: Synthetic oligonucleotide
ucauaguugguguagaugagg

SEQ ID NO: 935 - DNA, 21 bp, Artificial Sequence
  Description of Artificial Sequence: Synthetic oligonucleotide
  Description of Combined DNA/RNA Molecule: Synthetic oligonucleotide
cucauaguugguguagaugag

SEQ ID NO: 936 - DNA, 21 bp, Artificial Sequence
  Description of Artificial Sequence: Synthetic oligonucleotide
  Description of Combined DNA/RNA Molecule: Synthetic oligonucleotide
ccucauaguugguguagauga

SEQ ID NO: 937 - DNA, 21 bp, Artificial Sequence
  Description of Artificial Sequence: Synthetic oligonucleotide
  Description of Combined DNA/RNA Molecule: Synthetic oligonucleotide
gccucauaguugguguagatg

SEQ ID NO: 938 - DNA, 21 bp, Artificial Sequence
  Description of Artificial Sequence: Synthetic oligonucleotide
  Description of Combined DNA/RNA Molecule: Synthetic oligonucleotide
cgccucauaguugguguagat

SEQ ID NO: 939 - DNA, 21 bp, Artificial Sequence
  Description of Artificial Sequence: Synthetic oligonucleotide
  Description of Combined DNA/RNA Molecule: Synthetic oligonucleotide
ccgccucauaguugguguaga

SEQ ID NO: 940 - DNA, 21 bp, Artificial Sequence
  Description of Artificial Sequence: Synthetic oligonucleotide
  Description of Combined DNA/RNA Molecule: Synthetic oligonucleotide
cccgccucauaguugguguag

SEQ ID NO: 941 - DNA, 21 bp, Artificial Sequence
  Description of Artificial Sequence: Synthetic oligonucleotide
  Description of Combined DNA/RNA Molecule: Synthetic oligonucleotide
gcccgccucauaguuggugta

SEQ ID NO: 942 - DNA, 21 bp, Artificial Sequence
  Description of Artificial Sequence: Synthetic oligonucleotide
  Description of Combined DNA/RNA Molecule: Synthetic oligonucleotide
ugcccgccucauaguuggugt

SEQ ID NO: 943 - DNA, 21 bp, Artificial Sequence
  Description of Artificial Sequence: Synthetic oligonucleotide
  Description of Combined DNA/RNA Molecule: Synthetic oligonucleotide
uugcccgccucauaguuggtg

SEQ ID NO: 944 - DNA, 21 bp, Artificial Sequence
  Description of Artificial Sequence: Synthetic oligonucleotide
  Description of Combined DNA/RNA Molecule: Synthetic oligonucleotide
cuugcccgccucauaguuggt

SEQ ID NO: 945 - DNA, 21 bp, Artificial Sequence
  Description of Artificial Sequence: Synthetic oligonucleotide
  Description of Combined DNA/RNA Molecule: Synthetic oligonucleotide
ccuugcccgccucauaguugg

SEQ ID NO: 946 - DNA, 21 bp, Artificial Sequence
  Description of Artificial Sequence: Synthetic oligonucleotide
  Description of Combined DNA/RNA Molecule: Synthetic oligonucleotide
uccuugcccgccucauagutg

SEQ ID NO: 947 - DNA, 21 bp, Artificial Sequence
  Description of Artificial Sequence: Synthetic oligonucleotide
  Description of Combined DNA/RNA Molecule: Synthetic oligonucleotide
auccuugcccgccucauagtt

SEQ ID NO: 948 - DNA, 21 bp, Artificial Sequence
  Description of Artificial Sequence: Synthetic oligonucleotide
  Description of Combined DNA/RNA Molecule: Synthetic oligonucleotide
cauccuugcccgccucauagt

SEQ ID NO: 949 - DNA, 21 bp, Artificial Sequence
  Description of Artificial Sequence: Synthetic oligonucleotide
  Description of Combined DNA/RNA Molecule: Synthetic oligonucleotide
ucauccuugcccgccucauag

SEQ ID NO: 950 - DNA, 21 bp, Artificial Sequence
  Description of Artificial Sequence: Synthetic oligonucleotide
  Description of Combined DNA/RNA Molecule: Synthetic oligonucleotide
gucauccuugcccgccucata

SEQ ID NO: 951 - DNA, 21 bp, Artificial Sequence
  Description of Artificial Sequence: Synthetic oligonucleotide
  Description of Combined DNA/RNA Molecule: Synthetic oligonucleotide
agucauccuugcccgccucat

SEQ ID NO: 952 - DNA, 21 bp, Artificial Sequence
  Description of Artificial Sequence: Synthetic oligonucleotide
  Description of Combined DNA/RNA Molecule: Synthetic oligonucleotide
uagucauccuugcccgccuca

SEQ ID NO: 953 - DNA, 21 bp, Artificial Sequence
  Description of Artificial Sequence: Synthetic oligonucleotide
  Description of Combined DNA/RNA Molecule: Synthetic oligonucleotide
auagucauccuugcccgcctc

SEQ ID NO: 954 - DNA, 21 bp, Artificial Sequence
  Description of Artificial Sequence: Synthetic oligonucleotide
  Description of Combined DNA/RNA Molecule: Synthetic oligonucleotide
cauagucauccuugcccgcct

SEQ ID NO: 955 - DNA, 21 bp, Artificial Sequence
  Description of Artificial Sequence: Synthetic oligonucleotide
  Description of Combined DNA/RNA Molecule: Synthetic oligonucleotide
acauagucauccuugcccgcc

SEQ ID NO: 956 - DNA, 21 bp, Artificial Sequence
  Description of Artificial Sequence: Synthetic oligonucleotide
  Description of Combined DNA/RNA Molecule: Synthetic oligonucleotide
cacauagucauccuugcccgc

SEQ ID NO: 957 - DNA, 21 bp, Artificial Sequence
  Description of Artificial Sequence: Synthetic oligonucleotide
  Description of Combined DNA/RNA Molecule: Synthetic oligonucleotide
ucacauagucauccuugcccg

SEQ ID NO: 958 - DNA, 21 bp, Artificial Sequence
  Description of Artificial Sequence: Synthetic oligonucleotide
  Description of Combined DNA/RNA Molecule: Synthetic oligonucleotide
uucacauagucauccuugccc

SEQ ID NO: 959 - DNA, 21 bp, Artificial Sequence
  Description of Artificial Sequence: Synthetic oligonucleotide
  Description of Combined DNA/RNA Molecule: Synthetic oligonucleotide
cuucacauagucauccuugcc

SEQ ID NO: 960 - DNA, 21 bp, Artificial Sequence
  Description of Artificial Sequence: Synthetic oligonucleotide
  Description of Combined DNA/RNA Molecule: Synthetic oligonucleotide
ccuucacauagucauccuugc

SEQ ID NO: 961 - DNA, 21 bp, Artificial Sequence
  Description of Artificial Sequence: Synthetic oligonucleotide
  Description of Combined DNA/RNA Molecule: Synthetic oligonucleotide
gccuucacauagucauccutg

SEQ ID NO: 962 - DNA, 21 bp, Artificial Sequence
  Description of Artificial Sequence: Synthetic oligonucleotide
  Description of Combined DNA/RNA Molecule: Synthetic oligonucleotide
ugccuucacauagucaucctt

SEQ ID NO: 963 - DNA, 21 bp, Artificial Sequence
  Description of Artificial Sequence: Synthetic oligonucleotide
  Description of Combined DNA/RNA Molecule: Synthetic oligonucleotide
gugccuucacauagucaucct

SEQ ID NO: 964 - DNA, 21 bp, Artificial Sequence
  Description of Artificial Sequence: Synthetic oligonucleotide
  Description of Combined DNA/RNA Molecule: Synthetic oligonucleotide
agugccuucacauagucaucc

SEQ ID NO: 965 - DNA, 21 bp, Artificial Sequence
  Description of Artificial Sequence: Synthetic oligonucleotide
  Description of Combined DNA/RNA Molecule: Synthetic oligonucleotide
cagugccuucacauagucatc

SEQ ID NO: 966 - DNA, 21 bp, Artificial Sequence
  Description of Artificial Sequence: Synthetic oligonucleotide
  Description of Combined DNA/RNA Molecule: Synthetic oligonucleotide
gcagugccuucacauagucat

SEQ ID NO: 967 - DNA, 21 bp, Artificial Sequence
  Description of Artificial Sequence: Synthetic oligonucleotide
  Description of Combined DNA/RNA Molecule: Synthetic oligonucleotide
ggcagugccuucacauaguca

SEQ ID NO: 968 - DNA, 21 bp, Artificial Sequence
  Description of Artificial Sequence: Synthetic oligonucleotide
  Description of Combined DNA/RNA Molecule: Synthetic oligonucleotide
gggcagugccuucacauagtc

SEQ ID NO: 969 - DNA, 21 bp, Artificial Sequence
  Description of Artificial Sequence: Synthetic oligonucleotide
  Description of Combined DNA/RNA Molecule: Synthetic oligonucleotide
cgggcagugccuucacauagt

SEQ ID NO: 970 - DNA, 21 bp, Artificial Sequence
  Description of Artificial Sequence: Synthetic oligonucleotide
  Description of Combined DNA/RNA Molecule: Synthetic oligonucleotide
ccgggcagugccuucacauag

SEQ ID NO: 971 - DNA, 21 bp, Artificial Sequence
  Description of Artificial Sequence: Synthetic oligonucleotide
  Description of Combined DNA/RNA Molecule: Synthetic oligonucleotide
cccgggcagugccuucacata

SEQ ID NO: 972 - DNA, 21 bp, Artificial Sequence
  Description of Artificial Sequence: Synthetic oligonucleotide
  Description of Combined DNA/RNA Molecule: Synthetic oligonucleotide
gcccgggcagugccuucacat

SEQ ID NO: 973 - DNA, 21 bp, Artificial Sequence
  Description of Artificial Sequence: Synthetic oligonucleotide
  Description of Combined DNA/RNA Molecule: Synthetic oligonucleotide
ugcccgggcagugccuucaca

SEQ ID NO: 974 - DNA, 21 bp, Artificial Sequence
  Description of Artificial Sequence: Synthetic oligonucleotide
  Description of Combined DNA/RNA Molecule: Synthetic oligonucleotide
uugcccgggcagugccuucac

SEQ ID NO: 975 - DNA, 21 bp, Artificial Sequence
  Description of Artificial Sequence: Synthetic oligonucleotide
  Description of Combined DNA/RNA Molecule: Synthetic oligonucleotide
guugcccgggcagugccuuca

SEQ ID NO: 976 - DNA, 21 bp, Artificial Sequence
  Description of Artificial Sequence: Synthetic oligonucleotide
  Description of Combined DNA/RNA Molecule: Synthetic oligonucleotide
aguugcccgggcagugccutc

SEQ ID NO: 977 - DNA, 21 bp, Artificial Sequence
  Description of Artificial Sequence: Synthetic oligonucleotide
  Description of Combined DNA/RNA Molecule: Synthetic oligonucleotide
caguugcccgggcagugcctt

SEQ ID NO: 978 - DNA, 21 bp, Artificial Sequence
  Description of Artificial Sequence: Synthetic oligonucleotide
  Description of Combined DNA/RNA Molecule: Synthetic oligonucleotide
ucaguugcccgggcagugcct

SEQ ID NO: 979 - DNA, 21 bp, Artificial Sequence
  Description of Artificial Sequence: Synthetic oligonucleotide
  Description of Combined DNA/RNA Molecule: Synthetic oligonucleotide
uucaguugcccgggcagugcc

SEQ ID NO: 980 - DNA, 21 bp, Artificial Sequence
  Description of Artificial Sequence: Synthetic oligonucleotide
  Description of Combined DNA/RNA Molecule: Synthetic oligonucleotide
cuucaguugcccgggcagugc

SEQ ID NO: 981 - DNA, 21 bp, Artificial Sequence
  Description of Artificial Sequence: Synthetic oligonucleotide
  Description of Combined DNA/RNA Molecule: Synthetic oligonucleotide
gcuucaguugcccgggcagtg

SEQ ID NO: 982 - DNA, 21 bp, Artificial Sequence
  Description of Artificial Sequence: Synthetic oligonucleotide
  Description of Combined DNA/RNA Molecule: Synthetic oligonucleotide
ggcuucaguugcccgggcagt

SEQ ID NO: 983 - DNA, 21 bp, Artificial Sequence
  Description of Artificial Sequence: Synthetic oligonucleotide
  Description of Combined DNA/RNA Molecule: Synthetic oligonucleotide
aggcuucaguugcccgggcag

SEQ ID NO: 984 - DNA, 21 bp, Artificial Sequence
  Description of Artificial Sequence: Synthetic oligonucleotide
  Description of Combined DNA/RNA Molecule: Synthetic oligonucleotide
aaggcuucaguugcccgggca

SEQ ID NO: 985 - DNA, 21 bp, Artificial Sequence
  Description of Artificial Sequence: Synthetic oligonucleotide
  Description of Combined DNA/RNA Molecule: Synthetic oligonucleotide
aaaggcuucaguugcccgggc

SEQ ID NO: 986 - DNA, 21 bp, Artificial Sequence
  Description of Artificial Sequence: Synthetic oligonucleotide
  Description of Combined DNA/RNA Molecule: Synthetic oligonucleotide
aaaaggcuucaguugcccggg

SEQ ID NO: 987 - DNA, 21 bp, Artificial Sequence
  Description of Artificial Sequence: Synthetic oligonucleotide
  Description of Combined DNA/RNA Molecule: Synthetic oligonucleotide
caaaaggcuucaguugcccgg

SEQ ID NO: 988 - DNA, 21 bp, Artificial Sequence
  Description of Artificial Sequence: Synthetic oligonucleotide
  Description of Combined DNA/RNA Molecule: Synthetic oligonucleotide
ucaaaaggcuucaguugcccg

SEQ ID NO: 989 - DNA, 21 bp, Artificial Sequence
  Description of Artificial Sequence: Synthetic oligonucleotide
  Description of Combined DNA/RNA Molecule: Synthetic oligonucleotide
cucaaaaggcuucaguugccc

SEQ ID NO: 990 - DNA, 21 bp, Artificial Sequence
  Description of Artificial Sequence: Synthetic oligonucleotide
  Description of Combined DNA/RNA Molecule: Synthetic oligonucleotide
ucucaaaaggcuucaguugcc

SEQ ID NO: 991 - DNA, 21 bp, Artificial Sequence
  Description of Artificial Sequence: Synthetic oligonucleotide
  Description of Combined DNA/RNA Molecule: Synthetic oligonucleotide
gucucaaaaggcuucaguugc

SEQ ID NO: 992 - DNA, 21 bp, Artificial Sequence
  Description of Artificial Sequence: Synthetic oligonucleotide
  Description of Combined DNA/RNA Molecule: Synthetic oligonucleotide
ggucucaaaaggcuucagutg

SEQ ID NO: 993 - DNA, 21 bp, Artificial Sequence
  Description of Artificial Sequence: Synthetic oligonucleotide
  Description of Combined DNA/RNA Molecule: Synthetic oligonucleotide
ugucucaaaaggcuucagutg

SEQ ID NO: 994 - DNA, 21 bp, Artificial Sequence
  Description of Artificial Sequence: Synthetic oligonucleotide
  Description of Combined DNA/RNA Molecule: Synthetic oligonucleotide
gggucucaaaaggcuucagtt

SEQ ID NO: 995 - DNA, 21 bp, Artificial Sequence
  Description of Artificial Sequence: Synthetic oligonucleotide
  Description of Combined DNA/RNA Molecule: Synthetic oligonucleotide
agggucucaaaaggcuucagt

SEQ ID NO: 996 - DNA, 21 bp, Artificial Sequence
  Description of Artificial Sequence: Synthetic oligonucleotide
  Description of Combined DNA/RNA Molecule: Synthetic oligonucleotide
cagggucucaaaaggcuucag

SEQ ID NO: 997 - DNA, 21 bp, Artificial Sequence
  Description of Artificial Sequence: Synthetic oligonucleotide
  Description of Combined DNA/RNA Molecule: Synthetic oligonucleotide
gcagggucucaaaaggcuuca

SEQ ID NO: 998 - DNA, 21 bp, Artificial Sequence
  Description of Artificial Sequence: Synthetic oligonucleotide
  Description of Combined DNA/RNA Molecule: Synthetic oligonucleotide
uagggucucaaaaggcuucag

SEQ ID NO: 999 - DNA, 21 bp, Artificial Sequence
  Description of Artificial Sequence: Synthetic oligonucleotide
  Description of Combined DNA/RNA Molecule: Synthetic oligonucleotide
agcagggucucaaaaggcutc

SEQ ID NO: 1000 - DNA, 21 bp, Artificial Sequence
  Description of Artificial Sequence: Synthetic oligonucleotide
  Description of Combined DNA/RNA Molecule: Synthetic oligonucleotide
ugcagggucucaaaaggcgtc

SEQ ID NO: 1001 - DNA, 21 bp, Artificial Sequence
  Description of Artificial Sequence: Synthetic oligonucleotide
  Description of Combined DNA/RNA Molecule: Synthetic oligonucleotide
ugcagggucucaaaaggcutc

SEQ ID NO: 1002 - DNA, 21 bp, Artificial Sequence
  Description of Artificial Sequence: Synthetic oligonucleotide
  Description of Combined DNA/RNA Molecule: Synthetic oligonucleotide
cagcagggucucaaaaggctt

SEQ ID NO: 1003 - DNA, 21 bp, Artificial Sequence
  Description of Artificial Sequence: Synthetic oligonucleotide
  Description of Combined DNA/RNA Molecule: Synthetic oligonucleotide
acagcagggucucaaaaggct

SEQ ID NO: 1004 - DNA, 21 bp, Artificial Sequence
  Description of Artificial Sequence: Synthetic oligonucleotide
  Description of Combined DNA/RNA Molecule: Synthetic oligonucleotide
ucagcagggucucaaaaggct

SEQ ID NO: 1005 - DNA, 21 bp, Artificial Sequence
  Description of Artificial Sequence: Synthetic oligonucleotide
  Description of Combined DNA/RNA Molecule: Synthetic oligonucleotide
gacagcagggucucaaaaggc

SEQ ID NO: 1006 - DNA, 21 bp, Artificial Sequence
  Description of Artificial Sequence: Synthetic oligonucleotide
  Description of Combined DNA/RNA Molecule: Synthetic oligonucleotide
uacagcagggucucaaaaggc

SEQ ID NO: 1007 - DNA, 21 bp, Artificial Sequence
  Description of Artificial Sequence: Synthetic oligonucleotide
  Description of Combined DNA/RNA Molecule: Synthetic oligonucleotide
ggacagcagggucucaaaagg

SEQ ID NO: 1008 - DNA, 21 bp, Artificial Sequence
  Description of Artificial Sequence: Synthetic oligonucleotide
  Description of Combined DNA/RNA Molecule: Synthetic oligonucleotide
gggacagcagggucucaaaag

SEQ ID NO: 1009 - DNA, 21 bp, Artificial Sequence
  Description of Artificial Sequence: Synthetic oligonucleotide
  Description of Combined DNA/RNA Molecule: Synthetic oligonucleotide
ugggacagcagggucucaaaa

SEQ ID NO: 1010 - DNA, 21 bp, Artificial Sequence
  Description of Artificial Sequence: Synthetic oligonucleotide
  Description of Combined DNA/RNA Molecule: Synthetic oligonucleotide
cugggacagcagggucucaaa

SEQ ID NO: 1011 - DNA, 21 bp, Artificial Sequence
  Description of Artificial Sequence: Synthetic oligonucleotide
  Description of Combined DNA/RNA Molecule: Synthetic oligonucleotide
ucugggacagcagggucucaa

SEQ ID NO: 1012 - DNA, 21 bp, Artificial Sequence
  Description of Artificial Sequence: Synthetic oligonucleotide
  Description of Combined DNA/RNA Molecule: Synthetic oligonucleotide
uucugggacagcagggucuca

SEQ ID NO: 1013 - DNA, 21 bp, Artificial Sequence
  Description of Artificial Sequence: Synthetic oligonucleotide
  Description of Combined DNA/RNA Molecule: Synthetic oligonucleotide
guucugggacagcaggguctc

SEQ ID NO: 1014 - DNA, 21 bp, Artificial Sequence
  Description of Artificial Sequence: Synthetic oligonucleotide
  Description of Combined DNA/RNA Molecule: Synthetic oligonucleotide
gguucugggacagcaggguct

SEQ ID NO: 1015 - DNA, 21 bp, Artificial Sequence
  Description of Artificial Sequence: Synthetic oligonucleotide
  Description of Combined DNA/RNA Molecule: Synthetic oligonucleotide
uguucugggacagcaggguct

SEQ ID NO: 1016 - DNA, 21 bp, Artificial Sequence
  Description of Artificial Sequence: Synthetic oligonucleotide
  Description of Combined DNA/RNA Molecule: Synthetic oligonucleotide
ugguucugggacagcagggtc

SEQ ID NO: 1017 - DNA, 21 bp, Artificial Sequence
  Description of Artificial Sequence: Synthetic oligonucleotide
  Description of Combined DNA/RNA Molecule: Synthetic oligonucleotide
cugguucugggacagcagggt

SEQ ID NO: 1018 - DNA, 21 bp, Artificial Sequence
  Description of Artificial Sequence: Synthetic oligonucleotide
  Description of Combined DNA/RNA Molecule: Synthetic oligonucleotide
ccugguucugggacagcaggg

SEQ ID NO: 1019 - DNA, 21 bp, Artificial Sequence
  Description of Artificial Sequence: Synthetic oligonucleotide
  Description of Combined DNA/RNA Molecule: Synthetic oligonucleotide
cccugguucugggacagcagg

SEQ ID NO: 1020 - DNA, 21 bp, Artificial Sequence
  Description of Artificial Sequence: Synthetic oligonucleotide
  Description of Combined DNA/RNA Molecule: Synthetic oligonucleotide
uccugguucugggacagcagg

SEQ ID NO: 1021 - DNA, 21 bp, Artificial Sequence
  Description of Artificial Sequence: Synthetic oligonucleotide
  Description of Combined DNA/RNA Molecule: Synthetic oligonucleotide
ucccugguucugggacagcag

SEQ ID NO: 1022 - DNA, 21 bp, Artificial Sequence
  Description of Artificial Sequence: Synthetic oligonucleotide
  Description of Combined DNA/RNA Molecule: Synthetic oligonucleotide
cucccugguucugggacagca

SEQ ID NO: 1023 - DNA, 21 bp, Artificial Sequence
  Description of Artificial Sequence: Synthetic oligonucleotide
  Description of Combined DNA/RNA Molecule: Synthetic oligonucleotide
ccucccugguucugggacagc

SEQ ID NO: 1024 - DNA, 21 bp, Artificial Sequence
  Description of Artificial Sequence: Synthetic oligonucleotide
  Description of Combined DNA/RNA Molecule: Synthetic oligonucleotide
gccucccugguucugggacag

SEQ ID NO: 1025 - DNA, 21 bp, Artificial Sequence
  Description of Artificial Sequence: Synthetic oligonucleotide
  Description of Combined DNA/RNA Molecule: Synthetic oligonucleotide
ugccucccugguucugggaca

SEQ ID NO: 1026 - DNA, 21 bp, Artificial Sequence
  Description of Artificial Sequence: Synthetic oligonucleotide
  Description of Combined DNA/RNA Molecule: Synthetic oligonucleotide
uugccucccugguucugggac

SEQ ID NO: 1027 - DNA, 21 bp, Artificial Sequence
  Description of Artificial Sequence: Synthetic oligonucleotide
  Description of Combined DNA/RNA Molecule: Synthetic oligonucleotide
cuugccucccugguucuggga

SEQ ID NO: 1028 - DNA, 21 bp, Artificial Sequence
  Description of Artificial Sequence: Synthetic oligonucleotide
  Description of Combined DNA/RNA Molecule: Synthetic oligonucleotide
ucuugccucccugguucuggg

SEQ ID NO: 1029 - DNA, 21 bp, Artificial Sequence
  Description of Artificial Sequence: Synthetic oligonucleotide
  Description of Combined DNA/RNA Molecule: Synthetic oligonucleotide
gucuugccucccugguucugg

SEQ ID NO: 1030 - DNA, 21 bp, Artificial Sequence
  Description of Artificial Sequence: Synthetic oligonucleotide
  Description of Combined DNA/RNA Molecule: Synthetic oligonucleotide
ggucuugccucccugguuctg

SEQ ID NO: 1031 - DNA, 21 bp, Artificial Sequence
  Description of Artificial Sequence: Synthetic oligonucleotide
  Description of Combined DNA/RNA Molecule: Synthetic oligonucleotide
aggucuugccucccugguuct

SEQ ID NO: 1032 - DNA, 21 bp, Artificial Sequence
  Description of Artificial Sequence: Synthetic oligonucleotide
  Description of Combined DNA/RNA Molecule: Synthetic oligonucleotide
aaggucuugccucccuggutc

SEQ ID NO: 1033 - DNA, 21 bp, Artificial Sequence
  Description of Artificial Sequence: Synthetic oligonucleotide
  Description of Combined DNA/RNA Molecule: Synthetic oligonucleotide
gaaggucuugccucccuggtt

SEQ ID NO: 1034 - DNA, 21 bp, Artificial Sequence
  Description of Artificial Sequence: Synthetic oligonucleotide
  Description of Combined DNA/RNA Molecule: Synthetic oligonucleotide
ugaaggucuugccucccuggt

SEQ ID NO: 1035 - DNA, 21 bp, Artificial Sequence
  Description of Artificial Sequence: Synthetic oligonucleotide
  Description of Combined DNA/RNA Molecule: Synthetic oligonucleotide
augaaggucuugccucccugg

SEQ ID NO: 1036 - DNA, 21 bp, Artificial Sequence
  Description of Artificial Sequence: Synthetic oligonucleotide
  Description of Combined DNA/RNA Molecule: Synthetic oligonucleotide
aaugaaggucuugccuccctg

SEQ ID NO: 1037 - DNA, 21 bp, Artificial Sequence
  Description of Artificial Sequence: Synthetic oligonucleotide
  Description of Combined DNA/RNA Molecule: Synthetic oligonucleotide
caaugaaggucuugccuccct

SEQ ID NO: 1038 - DNA, 21 bp, Artificial Sequence
  Description of Artificial Sequence: Synthetic oligonucleotide
  Description of Combined DNA/RNA Molecule: Synthetic oligonucleotide
acaaugaaggucuugccuccc

SEQ ID NO: 1039 - DNA, 21 bp, Artificial Sequence
  Description of Artificial Sequence: Synthetic oligonucleotide
  Description of Combined DNA/RNA Molecule: Synthetic oligonucleotide
cacaaugaaggucuugccucc

SEQ ID NO: 1040 - DNA, 21 bp, Artificial Sequence
  Description of Artificial Sequence: Synthetic oligonucleotide
  Description of Combined DNA/RNA Molecule: Synthetic oligonucleotide
ccacaaugaaggucuugcctc

SEQ ID NO: 1041 - DNA, 21 bp, Artificial Sequence
  Description of Artificial Sequence: Synthetic oligonucleotide
  Description of Combined DNA/RNA Molecule: Synthetic oligonucleotide
cccacaaugaaggucuugcct

SEQ ID NO: 1042 - DNA, 21 bp, Artificial Sequence
  Description of Artificial Sequence: Synthetic oligonucleotide
  Description of Combined DNA/RNA Molecule: Synthetic oligonucleotide
ucccacaaugaaggucuugcc

SEQ ID NO: 1043 - DNA, 21 bp, Artificial Sequence
  Description of Artificial Sequence: Synthetic oligonucleotide
  Description of Combined DNA/RNA Molecule: Synthetic oligonucleotide
cucccacaaugaaggucuugc

SEQ ID NO: 1044 - DNA, 21 bp, Artificial Sequence
  Description of Artificial Sequence: Synthetic oligonucleotide
  Description of Combined DNA/RNA Molecule: Synthetic oligonucleotide
ucucccacaaugaaggucutg

SEQ ID NO: 1045 - DNA, 21 bp, Artificial Sequence
  Description of Artificial Sequence: Synthetic oligonucleotide
  Description of Combined DNA/RNA Molecule: Synthetic oligonucleotide
gucucccacaaugaagguctt

SEQ ID NO: 1046 - DNA, 21 bp, Artificial Sequence
  Description of Artificial Sequence: Synthetic oligonucleotide
  Description of Combined DNA/RNA Molecule: Synthetic oligonucleotide
ggucucccacaaugaagguct

SEQ ID NO: 1047 - DNA, 21 bp, Artificial Sequence
  Description of Artificial Sequence: Synthetic oligonucleotide
  Description of Combined DNA/RNA Molecule: Synthetic oligonucleotide
uggucucccacaaugaaggtc

SEQ ID NO: 1048 - DNA, 21 bp, Artificial Sequence
  Description of Artificial Sequence: Synthetic oligonucleotide
  Description of Combined DNA/RNA Molecule: Synthetic oligonucleotide
cuggucucccacaaugaaggt

SEQ ID NO: 1049 - DNA, 21 bp, Artificial Sequence
  Description of Artificial Sequence: Synthetic oligonucleotide
  Description of Combined DNA/RNA Molecule: Synthetic oligonucleotide
ucuggucucccacaaugaagg

SEQ ID NO: 1050 - DNA, 21 bp, Artificial Sequence
  Description of Artificial Sequence: Synthetic oligonucleotide
  Description of Combined DNA/RNA Molecule: Synthetic oligonucleotide
aucuggucucccacaaugaag

SEQ ID NO: 1051 - DNA, 21 bp, Artificial Sequence
  Description of Artificial Sequence: Synthetic oligonucleotide
  Description of Combined DNA/RNA Molecule: Synthetic oligonucleotide
gaucuggucucccacaaugaa

SEQ ID NO: 1052 - DNA, 21 bp, Artificial Sequence
  Description of Artificial Sequence: Synthetic oligonucleotide
  Description of Combined DNA/RNA Molecule: Synthetic oligonucleotide
agaucuggucucccacaauga

SEQ ID NO: 1053 - DNA, 21 bp, Artificial Sequence
  Description of Artificial Sequence: Synthetic oligonucleotide
  Description of Combined DNA/RNA Molecule: Synthetic oligonucleotide
gagaucuggucucccacaatg

SEQ ID NO: 1054 - DNA, 21 bp, Artificial Sequence
  Description of Artificial Sequence: Synthetic oligonucleotide
  Description of Combined DNA/RNA Molecule: Synthetic oligonucleotide
ggagaucuggucucccacaat

SEQ ID NO: 1055 - DNA, 21 bp, Artificial Sequence
  Description of Artificial Sequence: Synthetic oligonucleotide
  Description of Combined DNA/RNA Molecule: Synthetic oligonucleotide
aggagaucuggucucccacaa

SEQ ID NO: 1056 - DNA, 21 bp, Artificial Sequence
  Description of Artificial Sequence: Synthetic oligonucleotide
  Description of Combined DNA/RNA Molecule: Synthetic oligonucleotide
aaggagaucuggucucccaca

SEQ ID NO: 1057 - DNA, 21 bp, Artificial Sequence
  Description of Artificial Sequence: Synthetic oligonucleotide
  Description of Combined DNA/RNA Molecule: Synthetic oligonucleotide
gaaggagaucuggucucccac

SEQ ID NO: 1058 - DNA, 21 bp, Artificial Sequence
  Description of Artificial Sequence: Synthetic oligonucleotide
  Description of Combined DNA/RNA Molecule: Synthetic oligonucleotide
cgaaggagaucuggucuccca

SEQ ID NO: 1059 - DNA, 21 bp, Artificial Sequence
  Description of Artificial Sequence: Synthetic oligonucleotide
  Description of Combined DNA/RNA Molecule: Synthetic oligonucleotide
gcgaaggagaucuggucuccc

SEQ ID NO: 1060 - DNA, 21 bp, Artificial Sequence
  Description of Artificial Sequence: Synthetic oligonucleotide
  Description of Combined DNA/RNA Molecule: Synthetic oligonucleotide
agcgaaggagaucuggucucc

SEQ ID NO: 1061 - DNA, 21 bp, Artificial Sequence
  Description of Artificial Sequence: Synthetic oligonucleotide
  Description of Combined DNA/RNA Molecule: Synthetic oligonucleotide
cagcgaaggagaucugguctc

SEQ ID NO: 1062 - DNA, 21 bp, Artificial Sequence
  Description of Artificial Sequence: Synthetic oligonucleotide
  Description of Combined DNA/RNA Molecule: Synthetic oligonucleotide
ucagcgaaggagaucugguct

SEQ ID NO: 1063 - DNA, 21 bp, Artificial Sequence
  Description of Artificial Sequence: Synthetic oligonucleotide
  Description of Combined DNA/RNA Molecule: Synthetic oligonucleotide
gucagcgaaggagaucuggtc

SEQ ID NO: 1064 - DNA, 21 bp, Artificial Sequence
  Description of Artificial Sequence: Synthetic oligonucleotide
  Description of Combined DNA/RNA Molecule: Synthetic oligonucleotide
agucagcgaaggagaucuggt

SEQ ID NO: 1065 - DNA, 21 bp, Artificial Sequence
  Description of Artificial Sequence: Synthetic oligonucleotide
  Description of Combined DNA/RNA Molecule: Synthetic oligonucleotide
uagucagcgaaggagaucugg

SEQ ID NO: 1066 - DNA, 21 bp, Artificial Sequence
  Description of Artificial Sequence: Synthetic oligonucleotide
  Description of Combined DNA/RNA Molecule: Synthetic oligonucleotide
guagucagcgaaggagauctg

SEQ ID NO: 1067 - DNA, 21 bp, Artificial Sequence
  Description of Artificial Sequence: Synthetic oligonucleotide
  Description of Combined DNA/RNA Molecule: Synthetic oligonucleotide
uguagucagcgaaggagauct

SEQ ID NO: 1068 - DNA, 21 bp, Artificial Sequence
  Description of Artificial Sequence: Synthetic oligonucleotide
  Description of Combined DNA/RNA Molecule: Synthetic oligonucleotide
uuguagucagcgaaggagatc

SEQ ID NO: 1069 - DNA, 21 bp, Artificial Sequence
  Description of Artificial Sequence: Synthetic oligonucleotide
  Description of Combined DNA/RNA Molecule: Synthetic oligonucleotide
guuguagucagcgaaggagat

SEQ ID NO: 1070 - DNA, 21 bp, Artificial Sequence
  Description of Artificial Sequence: Synthetic oligonucleotide
  Description of Combined DNA/RNA Molecule: Synthetic oligonucleotide
gguuguagucagcgaaggaga

SEQ ID NO: 1071 - DNA, 21 bp, Artificial Sequence
  Description of Artificial Sequence: Synthetic oligonucleotide
  Description of Combined DNA/RNA Molecule: Synthetic oligonucleotide
agguuguagucagcgaaggag

SEQ ID NO: 1072 - DNA, 21 bp, Artificial Sequence
  Description of Artificial Sequence: Synthetic oligonucleotide
  Description of Combined DNA/RNA Molecule: Synthetic oligonucleotide
cagguuguagucagcgaagga

SEQ ID NO: 1073 - DNA, 21 bp, Artificial Sequence
  Description of Artificial Sequence: Synthetic oligonucleotide
  Description of Combined DNA/RNA Molecule: Synthetic oligonucleotide
gcagguuguagucagcgaagg

SEQ ID NO: 1074 - DNA, 21 bp, Artificial Sequence
  Description of Artificial Sequence: Synthetic oligonucleotide
  Description of Combined DNA/RNA Molecule: Synthetic oligonucleotide
agcagguuguagucagcgaag

SEQ ID NO: 1075 - DNA, 21 bp, Artificial Sequence
  Description of Artificial Sequence: Synthetic oligonucleotide
  Description of Combined DNA/RNA Molecule: Synthetic oligonucleotide
cagcagguuguagucagcgaa

SEQ ID NO: 1076 - DNA, 21 bp, Artificial Sequence
  Description of Artificial Sequence: Synthetic oligonucleotide
  Description of Combined DNA/RNA Molecule: Synthetic oligonucleotide
ccagcagguuguagucagcga

SEQ ID NO: 1077 - DNA, 21 bp, Artificial Sequence
  Description of Artificial Sequence: Synthetic oligonucleotide
  Description of Combined DNA/RNA Molecule: Synthetic oligonucleotide
uccagcagguuguagucagcg

SEQ ID NO: 1078 - DNA, 21 bp, Artificial Sequence
  Description of Artificial Sequence: Synthetic oligonucleotide
  Description of Combined DNA/RNA Molecule: Synthetic oligonucleotide
guccagcagguuguagucagc

SEQ ID NO: 1079 - DNA, 21 bp, Artificial Sequence
  Description of Artificial Sequence: Synthetic oligonucleotide
  Description of Combined DNA/RNA Molecule: Synthetic oligonucleotide
aguccagcagguuguagucag

SEQ ID NO: 1080 - DNA, 21 bp, Artificial Sequence
  Description of Artificial Sequence: Synthetic oligonucleotide
  Description of Combined DNA/RNA Molecule: Synthetic oligonucleotide
aaguccagcagguuguaguca

SEQ ID NO: 1081 - DNA, 21 bp, Artificial Sequence
  Description of Artificial Sequence: Synthetic oligonucleotide
  Description of Combined DNA/RNA Molecule: Synthetic oligonucleotide
caaguccagcagguuguagtc

SEQ ID NO: 1082 - DNA, 21 bp, Artificial Sequence
  Description of Artificial Sequence: Synthetic oligonucleotide
  Description of Combined DNA/RNA Molecule: Synthetic oligonucleotide
gcaaguccagcagguuguagt

SEQ ID NO: 1083 - DNA, 21 bp, Artificial Sequence
  Description of Artificial Sequence: Synthetic oligonucleotide
  Description of Combined DNA/RNA Molecule: Synthetic oligonucleotide
agcaaguccagcagguuguag

SEQ ID NO: 1084 - DNA, 21 bp, Artificial Sequence
  Description of Artificial Sequence: Synthetic oligonucleotide
  Description of Combined DNA/RNA Molecule: Synthetic oligonucleotide
cagcaaguccagcagguugta

SEQ ID NO: 1085 - DNA, 21 bp, Artificial Sequence
  Description of Artificial Sequence: Synthetic oligonucleotide
  Description of Combined DNA/RNA Molecule: Synthetic oligonucleotide
gcagcaaguccagcagguugt

SEQ ID NO: 1086 - DNA, 21 bp, Artificial Sequence
  Description of Artificial Sequence: Synthetic oligonucleotide
  Description of Combined DNA/RNA Molecule: Synthetic oligonucleotide
agcagcaaguccagcaggutg

SEQ ID NO: 1087 - DNA, 21 bp, Artificial Sequence
  Description of Artificial Sequence: Synthetic oligonucleotide
  Description of Combined DNA/RNA Molecule: Synthetic oligonucleotide
cagcagcaaguccagcaggtt

SEQ ID NO: 1088 - DNA, 21 bp, Artificial Sequence
  Description of Artificial Sequence: Synthetic oligonucleotide
  Description of Combined DNA/RNA Molecule: Synthetic oligonucleotide
ucagcagcaaguccagcaggt

SEQ ID NO: 1089 - DNA, 21 bp, Artificial Sequence
  Description of Artificial Sequence: Synthetic oligonucleotide
  Description of Combined DNA/RNA Molecule: Synthetic oligonucleotide
aucagcagcaaguccagcagg

SEQ ID NO: 1090 - DNA, 21 bp, Artificial Sequence
  Description of Artificial Sequence: Synthetic oligonucleotide
  Description of Combined DNA/RNA Molecule: Synthetic oligonucleotide
gaucagcagcaaguccagcag

SEQ ID NO: 1091 - DNA, 21 bp, Artificial Sequence
  Description of Artificial Sequence: Synthetic oligonucleotide
  Description of Combined DNA/RNA Molecule: Synthetic oligonucleotide
ggaucagcagcaaguccagca

SEQ ID NO: 1092 - DNA, 21 bp, Artificial Sequence
  Description of Artificial Sequence: Synthetic oligonucleotide
  Description of Combined DNA/RNA Molecule: Synthetic oligonucleotide
uggaucagcagcaaguccagc

SEQ ID NO: 1093 - DNA, 21 bp, Artificial Sequence
  Description of Artificial Sequence: Synthetic oligonucleotide
  Description of Combined DNA/RNA Molecule: Synthetic oligonucleotide
auggaucagcagcaaguccag

SEQ ID NO: 1094 - DNA, 21 bp, Artificial Sequence
  Description of Artificial Sequence: Synthetic oligonucleotide
  Description of Combined DNA/RNA Molecule: Synthetic oligonucleotide
cauggaucagcagcaagucca

SEQ ID NO: 1095 - DNA, 21 bp, Artificial Sequence
  Description of Artificial Sequence: Synthetic oligonucleotide
  Description of Combined DNA/RNA Molecule: Synthetic oligonucleotide
ucauggaucagcagcaagucc

SEQ ID NO: 1096 - DNA, 21 bp, Artificial Sequence
  Description of Artificial Sequence: Synthetic oligonucleotide
  Description of Combined DNA/RNA Molecule: Synthetic oligonucleotide
cucauggaucagcagcaagtc

SEQ ID NO: 1097 - DNA, 21 bp, Artificial Sequence
  Description of Artificial Sequence: Synthetic oligonucleotide
  Description of Combined DNA/RNA Molecule: Synthetic oligonucleotide
ccucauggaucagcagcaagt

SEQ ID NO: 1098 - DNA, 21 bp, Artificial Sequence
  Description of Artificial Sequence: Synthetic oligonucleotide
  Description of Combined DNA/RNA Molecule: Synthetic oligonucleotide
accucauggaucagcagcaag

SEQ ID NO: 1099 - DNA, 21 bp, Artificial Sequence
  Description of Artificial Sequence: Synthetic oligonucleotide
  Description of Combined DNA/RNA Molecule: Synthetic oligonucleotide
gaccucauggaucagcagcaa

SEQ ID NO: 1100 - DNA, 21 bp, Artificial Sequence
  Description of Artificial Sequence: Synthetic oligonucleotide
  Description of Combined DNA/RNA Molecule: Synthetic oligonucleotide
ggaccucauggaucagcagca

SEQ ID NO: 1101 - DNA, 21 bp, Artificial Sequence
  Description of Artificial Sequence: Synthetic oligonucleotide
  Description of Combined DNA/RNA Molecule: Synthetic oligonucleotide
aggaccucauggaucagcagc

SEQ ID NO: 1102 - DNA, 21 bp, Artificial Sequence
  Description of Artificial Sequence: Synthetic oligonucleotide
  Description of Combined DNA/RNA Molecule: Synthetic oligonucleotide
uaggaccucauggaucagcag

SEQ ID NO: 1103 - DNA, 21 bp, Artificial Sequence
  Description of Artificial Sequence: Synthetic oligonucleotide
  Description of Combined DNA/RNA Molecule: Synthetic oligonucleotide
cuaggaccucauggaucagca

SEQ ID NO: 1104 - DNA, 21 bp, Artificial Sequence
  Description of Artificial Sequence: Synthetic oligonucleotide
  Description of Combined DNA/RNA Molecule: Synthetic oligonucleotide
gcuaggaccucauggaucagc

SEQ ID NO: 1105 - DNA, 21 bp, Artificial Sequence
  Description of Artificial Sequence: Synthetic oligonucleotide
  Description of Combined DNA/RNA Molecule: Synthetic oligonucleotide
ggcuaggaccucauggaucag

SEQ ID NO: 1106 - DNA, 21 bp, Artificial Sequence
  Description of Artificial Sequence: Synthetic oligonucleotide
  Description of Combined DNA/RNA Molecule: Synthetic oligonucleotide
gggcuaggaccucauggauca

SEQ ID NO: 1107 - DNA, 21 bp, Artificial Sequence
  Description of Artificial Sequence: Synthetic oligonucleotide
  Description of Combined DNA/RNA Molecule: Synthetic oligonucleotide
cgcauccaggcagccaggggc

SEQ ID NO: 1108 - DNA, 21 bp, Artificial Sequence
  Description of Artificial Sequence: Synthetic oligonucleotide
  Description of Combined DNA/RNA Molecule: Synthetic oligonucleotide
acgcauccaggcagccagggg

SEQ ID NO: 1109 - DNA, 21 bp, Artificial Sequence
  Description of Artificial Sequence: Synthetic oligonucleotide
  Description of Combined DNA/RNA Molecule: Synthetic oligonucleotide
aacgcauccaggcagccaggg

SEQ ID NO: 1110 - DNA, 21 bp, Artificial Sequence
  Description of Artificial Sequence: Synthetic oligonucleotide
  Description of Combined DNA/RNA Molecule: Synthetic oligonucleotide
gaacgcauccaggcagccagg

SEQ ID NO: 1111 - DNA, 21 bp, Artificial Sequence
  Description of Artificial Sequence: Synthetic oligonucleotide
  Description of Combined DNA/RNA Molecule: Synthetic oligonucleotide
ggaacgcauccaggcagccag

SEQ ID NO: 1112 - DNA, 21 bp, Artificial Sequence
  Description of Artificial Sequence: Synthetic oligonucleotide
  Description of Combined DNA/RNA Molecule: Synthetic oligonucleotide
gggaacgcauccaggcagcca

SEQ ID NO: 1113 - DNA, 21 bp, Artificial Sequence
  Description of Artificial Sequence: Synthetic oligonucleotide
  Description of Combined DNA/RNA Molecule: Synthetic oligonucleotide
acauaugcugagagcaggggg

SEQ ID NO: 1114 - DNA, 21 bp, Artificial Sequence
  Description of Artificial Sequence: Synthetic oligonucleotide
  Description of Combined DNA/RNA Molecule: Synthetic oligonucleotide
cacauaugcugagagcagggg

SEQ ID NO: 1115 - DNA, 21 bp, Artificial Sequence
  Description of Artificial Sequence: Synthetic oligonucleotide
  Description of Combined DNA/RNA Molecule: Synthetic oligonucleotide
ccacauaugcugagagcaggg

SEQ ID NO: 1116 - DNA, 21 bp, Artificial Sequence
  Description of Artificial Sequence: Synthetic oligonucleotide
  Description of Combined DNA/RNA Molecule: Synthetic oligonucleotide
cccacauaugcugagagcagg

SEQ ID NO: 1117 - DNA, 21 bp, Artificial Sequence
  Description of Artificial Sequence: Synthetic oligonucleotide
  Description of Combined DNA/RNA Molecule: Synthetic oligonucleotide
gccgggcacugaggcgcccca

SEQ ID NO: 1118 - DNA, 21 bp, Artificial Sequence
  Description of Artificial Sequence: Synthetic oligonucleotide
  Description of Combined DNA/RNA Molecule: Synthetic oligonucleotide
ggccgggcacugaggcgcccc

SEQ ID NO: 1119 - DNA, 21 bp, Artificial Sequence
  Description of Artificial Sequence: Synthetic oligonucleotide
  Description of Combined DNA/RNA Molecule: Synthetic oligonucleotide
gggccgggcacugaggcgccc

SEQ ID NO: 1120 - DNA, 21 bp, Artificial Sequence
  Description of Artificial Sequence: Synthetic oligonucleotide
  Description of Combined DNA/RNA Molecule: Synthetic oligonucleotide
ugggccgggcacugaggcgcc

SEQ ID NO: 1121 - DNA, 21 bp, Artificial Sequence
  Description of Artificial Sequence: Synthetic oligonucleotide
  Description of Combined DNA/RNA Molecule: Synthetic oligonucleotide
uugggccgggcacugaggcgc

SEQ ID NO: 1122 - DNA, 21 bp, Artificial Sequence
  Description of Artificial Sequence: Synthetic oligonucleotide
  Description of Combined DNA/RNA Molecule: Synthetic oligonucleotide
cuugggccgggcacugaggcg

SEQ ID NO: 1123 - DNA, 21 bp, Artificial Sequence
  Description of Artificial Sequence: Synthetic oligonucleotide
  Description of Combined DNA/RNA Molecule: Synthetic oligonucleotide
gcuugggccgggcacugaggc

SEQ ID NO: 1124 - DNA, 21 bp, Artificial Sequence
  Description of Artificial Sequence: Synthetic oligonucleotide
  Description of Combined DNA/RNA Molecule: Synthetic oligonucleotide
agcuugggccgggcacugagg

SEQ ID NO: 1125 - DNA, 21 bp, Artificial Sequence
  Description of Artificial Sequence: Synthetic oligonucleotide
  Description of Combined DNA/RNA Molecule: Synthetic oligonucleotide
gagcuugggccgggcacugag

SEQ ID NO: 1126 - DNA, 21 bp, Artificial Sequence
  Description of Artificial Sequence: Synthetic oligonucleotide
  Description of Combined DNA/RNA Molecule: Synthetic oligonucleotide
ugagcuugggccgggcacuga

SEQ ID NO: 1127 - DNA, 21 bp, Artificial Sequence
  Description of Artificial Sequence: Synthetic oligonucleotide
  Description of Combined DNA/RNA Molecule: Synthetic oligonucleotide
uugagcuugggccgggcactg

SEQ ID NO: 1128 - DNA, 21 bp, Artificial Sequence
  Description of Artificial Sequence: Synthetic oligonucleotide
  Description of Combined DNA/RNA Molecule: Synthetic oligonucleotide
cuugagcuugggccgggcact

SEQ ID NO: 1129 - DNA, 21 bp, Artificial Sequence
  Description of Artificial Sequence: Synthetic oligonucleotide
  Description of Combined DNA/RNA Molecule: Synthetic oligonucleotide
ccuugagcuugggccgggcac

SEQ ID NO: 1130 - DNA, 21 bp, Artificial Sequence
  Description of Artificial Sequence: Synthetic oligonucleotide
  Description of Combined DNA/RNA Molecule: Synthetic oligonucleotide
gccuugagcuugggccgggca

SEQ ID NO: 1131 - DNA, 21 bp, Artificial Sequence
  Description of Artificial Sequence: Synthetic oligonucleotide
  Description of Combined DNA/RNA Molecule: Synthetic oligonucleotide
ggccuugagcuugggccgggc

SEQ ID NO: 1132 - DNA, 21 bp, Artificial Sequence
  Description of Artificial Sequence: Synthetic oligonucleotide
  Description of Combined DNA/RNA Molecule: Synthetic oligonucleotide
aggccuugagcuugggccggg

SEQ ID NO: 1133 - DNA, 21 bp, Artificial Sequence
  Description of Artificial Sequence: Synthetic oligonucleotide
  Description of Combined DNA/RNA Molecule: Synthetic oligonucleotide
aaggccuugagcuugggccgg

SEQ ID NO: 1134 - DNA, 21 bp, Artificial Sequence
  Description of Artificial Sequence: Synthetic oligonucleotide
  Description of Combined DNA/RNA Molecule: Synthetic oligonucleotide
gaaggccuugagcuugggccg

SEQ ID NO: 1135 - DNA, 21 bp, Artificial Sequence
  Description of Artificial Sequence: Synthetic oligonucleotide
  Description of Combined DNA/RNA Molecule: Synthetic oligonucleotide
ggaaggccuugagcuugggcc

SEQ ID NO: 1136 - DNA, 21 bp, Artificial Sequence
  Description of Artificial Sequence: Synthetic oligonucleotide
  Description of Combined DNA/RNA Molecule: Synthetic oligonucleotide
aggaaggccuugagcuugggc

SEQ ID NO: 1137 - DNA, 21 bp, Artificial Sequence
  Description of Artificial Sequence: Synthetic oligonucleotide
  Description of Combined DNA/RNA Molecule: Synthetic oligonucleotide
caggaaggccuugagcuuggg

SEQ ID NO: 1138 - DNA, 21 bp, Artificial Sequence
  Description of Artificial Sequence: Synthetic oligonucleotide
  Description of Combined DNA/RNA Molecule: Synthetic oligonucleotide
ccaggaaggccuugagcuugg

SEQ ID NO: 1139 - DNA, 21 bp, Artificial Sequence
  Description of Artificial Sequence: Synthetic oligonucleotide
  Description of Combined DNA/RNA Molecule: Synthetic oligonucleotide
gccaggaaggccuugagcutg

SEQ ID NO: 1140 - DNA, 21 bp, Artificial Sequence
  Description of Artificial Sequence: Synthetic oligonucleotide
  Description of Combined DNA/RNA Molecule: Synthetic oligonucleotide
ggccaggaaggccuugagctt

SEQ ID NO: 1141 - DNA, 21 bp, Artificial Sequence
  Description of Artificial Sequence: Synthetic oligonucleotide
  Description of Combined DNA/RNA Molecule: Synthetic oligonucleotide
aggccaggaaggccuugagct

SEQ ID NO: 1142 - DNA, 21 bp, Artificial Sequence
  Description of Artificial Sequence: Synthetic oligonucleotide
  Description of Combined DNA/RNA Molecule: Synthetic oligonucleotide
gaggccaggaaggccuugagc

SEQ ID NO: 1143 - DNA, 21 bp, Artificial Sequence
  Description of Artificial Sequence: Synthetic oligonucleotide
  Description of Combined DNA/RNA Molecule: Synthetic oligonucleotide
ggaggccaggaaggccuugag

SEQ ID NO: 1144 - DNA, 21 bp, Artificial Sequence
  Description of Artificial Sequence: Synthetic oligonucleotide
  Description of Combined DNA/RNA Molecule: Synthetic oligonucleotide
gggaggccaggaaggccuuga

SEQ ID NO: 1145 - DNA, 21 bp, Artificial Sequence
  Description of Artificial Sequence: Synthetic oligonucleotide
  Description of Combined DNA/RNA Molecule: Synthetic oligonucleotide
gagguucacguacucagggga

SEQ ID NO: 1146 - DNA, 21 bp, Artificial Sequence
  Description of Artificial Sequence: Synthetic oligonucleotide
  Description of Combined DNA/RNA Molecule: Synthetic oligonucleotide
ggagguucacguacucagggg

SEQ ID NO: 1147 - DNA, 21 bp, Artificial Sequence
  Description of Artificial Sequence: Synthetic oligonucleotide
  Description of Combined DNA/RNA Molecule: Synthetic oligonucleotide
gggagguucacguacucaggg

SEQ ID NO: 1148 - DNA, 21 bp, Artificial Sequence
  Description of Artificial Sequence: Synthetic oligonucleotide
  Description of Combined DNA/RNA Molecule: Synthetic oligonucleotide
ucccguugccauugaugggga

SEQ ID NO: 1149 - DNA, 21 bp, Artificial Sequence
  Description of Artificial Sequence: Synthetic oligonucleotide
  Description of Combined DNA/RNA Molecule: Synthetic oligonucleotide
uucccguugccauugaugggg

SEQ ID NO: 1150 - DNA, 21 bp, Artificial Sequence
  Description of Artificial Sequence: Synthetic oligonucleotide
  Description of Combined DNA/RNA Molecule: Synthetic oligonucleotide
uuucccguugccauugauggg

SEQ ID NO: 1151 - DNA, 21 bp, Artificial Sequence
  Description of Artificial Sequence: Synthetic oligonucleotide
  Description of Combined DNA/RNA Molecule: Synthetic oligonucleotide
guuucccguugccauugaugg

SEQ ID NO: 1152 - DNA, 21 bp, Artificial Sequence
  Description of Artificial Sequence: Synthetic oligonucleotide
  Description of Combined DNA/RNA Molecule: Synthetic oligonucleotide
uguuucccguugccauugatg

SEQ ID NO: 1153 - DNA, 21 bp, Artificial Sequence
  Description of Artificial Sequence: Synthetic oligonucleotide
  Description of Combined DNA/RNA Molecule: Synthetic oligonucleotide
cuguuucccguugccauugat

SEQ ID NO: 1154 - DNA, 21 bp, Artificial Sequence
  Description of Artificial Sequence: Synthetic oligonucleotide
  Description of Combined DNA/RNA Molecule: Synthetic oligonucleotide
acuguuucccguugccauuga

SEQ ID NO: 1155 - DNA, 21 bp, Artificial Sequence
  Description of Artificial Sequence: Synthetic oligonucleotide
  Description of Combined DNA/RNA Molecule: Synthetic oligonucleotide
cacuguuucccguugccautg

SEQ ID NO: 1156 - DNA, 21 bp, Artificial Sequence
  Description of Artificial Sequence: Synthetic oligonucleotide
  Description of Combined DNA/RNA Molecule: Synthetic oligonucleotide
ucacuguuucccguugccatt

SEQ ID NO: 1157 - DNA, 21 bp, Artificial Sequence
  Description of Artificial Sequence: Synthetic oligonucleotide
  Description of Combined DNA/RNA Molecule: Synthetic oligonucleotide
cucacuguuucccguugccat

SEQ ID NO: 1158 - DNA, 21 bp, Artificial Sequence
  Description of Artificial Sequence: Synthetic oligonucleotide
  Description of Combined DNA/RNA Molecule: Synthetic oligonucleotide
ccucacuguuucccguugcca

SEQ ID NO: 1159 - DNA, 21 bp, Artificial Sequence
  Description of Artificial Sequence: Synthetic oligonucleotide
  Description of Combined DNA/RNA Molecule: Synthetic oligonucleotide
cccucacuguuucccguugcc

SEQ ID NO: 1160 - DNA, 21 bp, Artificial Sequence
  Description of Artificial Sequence: Synthetic oligonucleotide
  Description of Combined DNA/RNA Molecule: Synthetic oligonucleotide
acccucacuguuucccguugc

SEQ ID NO: 1161 - DNA, 21 bp, Artificial Sequence
  Description of Artificial Sequence: Synthetic oligonucleotide
  Description of Combined DNA/RNA Molecule: Synthetic oligonucleotide
aacccucacuguuucccgutg

SEQ ID NO: 1162 - DNA, 21 bp, Artificial Sequence
  Description of Artificial Sequence: Synthetic oligonucleotide
  Description of Combined DNA/RNA Molecule: Synthetic oligonucleotide
caacccucacuguuucccgtt

SEQ ID NO: 1163 - DNA, 21 bp, Artificial Sequence
  Description of Artificial Sequence: Synthetic oligonucleotide
  Description of Combined DNA/RNA Molecule: Synthetic oligonucleotide
ccaacccucacuguuucccgt

SEQ ID NO: 1164 - DNA, 21 bp, Artificial Sequence
  Description of Artificial Sequence: Synthetic oligonucleotide
  Description of Combined DNA/RNA Molecule: Synthetic oligonucleotide
cccaacccucacuguuucccg

SEQ ID NO: 1165 - DNA, 21 bp, Artificial Sequence
  Description of Artificial Sequence: Synthetic oligonucleotide
  Description of Combined DNA/RNA Molecule: Synthetic oligonucleotide
gccucccgcucagaguccccc

SEQ ID NO: 1166 - DNA, 21 bp, Artificial Sequence
  Description of Artificial Sequence: Synthetic oligonucleotide
  Description of Combined DNA/RNA Molecule: Synthetic oligonucleotide
ugccucccgcucagagucccc

SEQ ID NO: 1167 - DNA, 21 bp, Artificial Sequence
  Description of Artificial Sequence: Synthetic oligonucleotide
  Description of Combined DNA/RNA Molecule: Synthetic oligonucleotide
ucugccucccgcucagagucc

SEQ ID NO: 1168 - DNA, 21 bp, Artificial Sequence
  Description of Artificial Sequence: Synthetic oligonucleotide
  Description of Combined DNA/RNA Molecule: Synthetic oligonucleotide
acucugccucccgcucagagt

SEQ ID NO: 1169 - DNA, 21 bp, Artificial Sequence
  Description of Artificial Sequence: Synthetic oligonucleotide
  Description of Combined DNA/RNA Molecule: Synthetic oligonucleotide
aacucugccucccgcucagag

SEQ ID NO: 1170 - DNA, 21 bp, Artificial Sequence
  Description of Artificial Sequence: Synthetic oligonucleotide
  Description of Combined DNA/RNA Molecule: Synthetic oligonucleotide
aaacucugccucccgcucaga

SEQ ID NO: 1171 - DNA, 21 bp, Artificial Sequence
  Description of Artificial Sequence: Synthetic oligonucleotide
  Description of Combined DNA/RNA Molecule: Synthetic oligonucleotide
caaacucugccucccgcucag

SEQ ID NO: 1172 - DNA, 21 bp, Artificial Sequence
  Description of Artificial Sequence: Synthetic oligonucleotide
  Description of Combined DNA/RNA Molecule: Synthetic oligonucleotide
gcaaacucugccucccgcuca

SEQ ID NO: 1173 - DNA, 21 bp, Artificial Sequence
  Description of Artificial Sequence: Synthetic oligonucleotide
  Description of Combined DNA/RNA Molecule: Synthetic oligonucleotide
ggcaaacucugccucccgctc

SEQ ID NO: 1174 - DNA, 21 bp, Artificial Sequence
  Description of Artificial Sequence: Synthetic oligonucleotide
  Description of Combined DNA/RNA Molecule: Synthetic oligonucleotide
aggcaaacucugccucccgct

SEQ ID NO: 1175 - DNA, 21 bp, Artificial Sequence
  Description of Artificial Sequence: Synthetic oligonucleotide
  Description of Combined DNA/RNA Molecule: Synthetic oligonucleotide
aaggcaaacucugccucccgc

SEQ ID NO: 1176 - DNA, 21 bp, Artificial Sequence
  Description of Artificial Sequence: Synthetic oligonucleotide
  Description of Combined DNA/RNA Molecule: Synthetic oligonucleotide
gaaggcaaacucugccucccg

SEQ ID NO: 1177 - DNA, 21 bp, Artificial Sequence
  Description of Artificial Sequence: Synthetic oligonucleotide
  Description of Combined DNA/RNA Molecule: Synthetic oligonucleotide
ggaaggcaaacucugccuccc

SEQ ID NO: 1178 - DNA, 21 bp, Artificial Sequence
  Description of Artificial Sequence: Synthetic oligonucleotide
  Description of Combined DNA/RNA Molecule: Synthetic oligonucleotide
aggaaggcaaacucugccucc

SEQ ID NO: 1179 - DNA, 21 bp, Artificial Sequence
  Description of Artificial Sequence: Synthetic oligonucleotide
  Description of Combined DNA/RNA Molecule: Synthetic oligonucleotide
aaggaaggcaaacucugcctc

SEQ ID NO: 1180 - DNA, 21 bp, Artificial Sequence
  Description of Artificial Sequence: Synthetic oligonucleotide
  Description of Combined DNA/RNA Molecule: Synthetic oligonucleotide
aaaggaaggcaaacucugcct

SEQ ID NO: 1181 - DNA, 21 bp, Artificial Sequence
  Description of Artificial Sequence: Synthetic oligonucleotide
  Description of Combined DNA/RNA Molecule: Synthetic oligonucleotide
gaaaggaaggcaaacucugcc

SEQ ID NO: 1182 - DNA, 21 bp, Artificial Sequence
  Description of Artificial Sequence: Synthetic oligonucleotide
  Description of Combined DNA/RNA Molecule: Synthetic oligonucleotide
agaaaggaaggcaaacucugc

SEQ ID NO: 1183 - DNA, 21 bp, Artificial Sequence
  Description of Artificial Sequence: Synthetic oligonucleotide
  Description of Combined DNA/RNA Molecule: Synthetic oligonucleotide
gagaaaggaaggcaaacuctg

SEQ ID NO: 1184 - DNA, 21 bp, Artificial Sequence
  Description of Artificial Sequence: Synthetic oligonucleotide
  Description of Combined DNA/RNA Molecule: Synthetic oligonucleotide
ggagaaaggaaggcaaacuct

SEQ ID NO: 1185 - DNA, 21 bp, Artificial Sequence
  Description of Artificial Sequence: Synthetic oligonucleotide
  Description of Combined DNA/RNA Molecule: Synthetic oligonucleotide
uggagaaaggaaggcaaactc

SEQ ID NO: 1186 - DNA, 21 bp, Artificial Sequence
  Description of Artificial Sequence: Synthetic oligonucleotide
  Description of Combined DNA/RNA Molecule: Synthetic oligonucleotide
cuggagaaaggaaggcaaact

SEQ ID NO: 1187 - DNA, 21 bp, Artificial Sequence
  Description of Artificial Sequence: Synthetic oligonucleotide
  Description of Combined DNA/RNA Molecule: Synthetic oligonucleotide
ccuggagaaaggaaggcaaac

SEQ ID NO: 1188 - DNA, 21 bp, Artificial Sequence
  Description of Artificial Sequence: Synthetic oligonucleotide
  Description of Combined DNA/RNA Molecule: Synthetic oligonucleotide
uccuggagaaaggaaggcaaa

SEQ ID NO: 1189 - DNA, 21 bp, Artificial Sequence
  Description of Artificial Sequence: Synthetic oligonucleotide
  Description of Combined DNA/RNA Molecule: Synthetic oligonucleotide
guccuggagaaaggaaggcaa

SEQ ID NO: 1190 - DNA, 21 bp, Artificial Sequence
  Description of Artificial Sequence: Synthetic oligonucleotide
  Description of Combined DNA/RNA Molecule: Synthetic oligonucleotide
gguccuggagaaaggaaggca

SEQ ID NO: 1191 - DNA, 21 bp, Artificial Sequence
  Description of Artificial Sequence: Synthetic oligonucleotide
  Description of Combined DNA/RNA Molecule: Synthetic oligonucleotide
ugguccuggagaaaggaaggc

SEQ ID NO: 1192 - DNA, 21 bp, Artificial Sequence
  Description of Artificial Sequence: Synthetic oligonucleotide
  Description of Combined DNA/RNA Molecule: Synthetic oligonucleotide
uugguccuggagaaaggaagg

SEQ ID NO: 1193 - DNA, 21 bp, Artificial Sequence
  Description of Artificial Sequence: Synthetic oligonucleotide
  Description of Combined DNA/RNA Molecule: Synthetic oligonucleotide
auugguccuggagaaaggaag

SEQ ID NO: 1194 - DNA, 21 bp, Artificial Sequence
  Description of Artificial Sequence: Synthetic oligonucleotide
  Description of Combined DNA/RNA Molecule: Synthetic oligonucleotide
uauugguccuggagaaaggaa

SEQ ID NO: 1195 - DNA, 21 bp, Artificial Sequence
  Description of Artificial Sequence: Synthetic oligonucleotide
  Description of Combined DNA/RNA Molecule: Synthetic oligonucleotide
uuauugguccuggagaaagga

SEQ ID NO: 1196 - DNA, 21 bp, Artificial Sequence
  Description of Artificial Sequence: Synthetic oligonucleotide
  Description of Combined DNA/RNA Molecule: Synthetic oligonucleotide
uuuauugguccuggagaaagg

SEQ ID NO: 1197 - DNA, 21 bp, Artificial Sequence
  Description of Artificial Sequence: Synthetic oligonucleotide
  Description of Combined DNA/RNA Molecule: Synthetic oligonucleotide
uuuuauugguccuggagaaag

SEQ ID NO: 1198 - DNA, 21 bp, Artificial Sequence
  Description of Artificial Sequence: Synthetic oligonucleotide
  Description of Combined DNA/RNA Molecule: Synthetic oligonucleotide
auuuuauugguccuggagaaa

SEQ ID NO: 1199 - DNA, 21 bp, Artificial Sequence
  Description of Artificial Sequence: Synthetic oligonucleotide
  Description of Combined DNA/RNA Molecule: Synthetic oligonucleotide
aauuuuauugguccuggagaa

SEQ ID NO: 1200 - DNA, 21 bp, Artificial Sequence
  Description of Artificial Sequence: Synthetic oligonucleotide
  Description of Combined DNA/RNA Molecule: Synthetic oligonucleotide
aaauuuuauugguccuggaga

SEQ ID NO: 1201 - DNA, 21 bp, Artificial Sequence
  Description of Artificial Sequence: Synthetic oligonucleotide
  Description of Combined DNA/RNA Molecule: Synthetic oligonucleotide
gaaauuuuauugguccuggag

SEQ ID NO: 1202 - DNA, 21 bp, Artificial Sequence
  Description of Artificial Sequence: Synthetic oligonucleotide
  Description of Combined DNA/RNA Molecule: Synthetic oligonucleotide
agaaauuuuauugguccugga

SEQ ID NO: 1203 - DNA, 21 bp, Artificial Sequence
  Description of Artificial Sequence: Synthetic oligonucleotide
  Description of Combined DNA/RNA Molecule: Synthetic oligonucleotide
uagaaauuuuauugguccugg

SEQ ID NO: 1204 - DNA, 21 bp, Artificial Sequence
  Description of Artificial Sequence: Synthetic oligonucleotide
  Description of Combined DNA/RNA Molecule: Synthetic oligonucleotide
uuagaaauuuuauuggucctg

SEQ ID NO: 1205 - DNA, 21 bp, Artificial Sequence
  Description of Artificial Sequence: Synthetic oligonucleotide
  Description of Combined DNA/RNA Molecule: Synthetic oligonucleotide
cuuagaaauuuuauuggucct

SEQ ID NO: 1206 - DNA, 21 bp, Artificial Sequence
  Description of Artificial Sequence: Synthetic oligonucleotide
  Description of Combined DNA/RNA Molecule: Synthetic oligonucleotide
ucuuagaaauuuuauuggucc

SEQ ID NO: 1207 - DNA, 21 bp, Artificial Sequence
  Description of Artificial Sequence: Synthetic oligonucleotide
  Description of Combined DNA/RNA Molecule: Synthetic oligonucleotide
cucuuagaaauuuuauuggtc

SEQ ID NO: 1208 - DNA, 21 bp, Artificial Sequence
  Description of Artificial Sequence: Synthetic oligonucleotide
  Description of Combined DNA/RNA Molecule: Synthetic oligonucleotide
ucucuuagaaauuuuauuggt

SEQ ID NO: 1209 - DNA, 21 bp, Artificial Sequence
  Description of Artificial Sequence: Synthetic oligonucleotide
  Description of Combined DNA/RNA Molecule: Synthetic oligonucleotide
cucucuuagaaauuuuauugg

SEQ ID NO: 1210 - DNA, 21 bp, Artificial Sequence
  Description of Artificial Sequence: Synthetic oligonucleotide
  Description of Combined DNA/RNA Molecule: Synthetic oligonucleotide
gcucucuuagaaauuuuautg

SEQ ID NO: 1211 - DNA, 21 bp, Artificial Sequence
  Description of Artificial Sequence: Synthetic oligonucleotide
  Description of Combined DNA/RNA Molecule: Synthetic oligonucleotide
agcucucuuagaaauuuuatt

SEQ ID NO: 1212 - DNA, 21 bp, Artificial Sequence
  Description of Artificial Sequence: Synthetic oligonucleotide
  Description of Combined DNA/RNA Molecule: Synthetic oligonucleotide
uagcucucuuagaaauuuuat

SEQ ID NO: 1213 - DNA, 21 bp, Artificial Sequence
  Description of Artificial Sequence: Synthetic oligonucleotide
  Description of Combined DNA/RNA Molecule: Synthetic oligonucleotide
uuagcucucuuagaaauuuta

SEQ ID NO: 1214 - DNA, 21 bp, Artificial Sequence
  Description of Artificial Sequence: Synthetic oligonucleotide
  Description of Combined DNA/RNA Molecule: Synthetic oligonucleotide
uuuagcucucuuagaaauutt

SEQ ID NO: 1215 - DNA, 21 bp, Artificial Sequence
  Description of Artificial Sequence: Synthetic oligonucleotide
  Description of Combined DNA/RNA Molecule: Synthetic oligonucleotide
uuuuagcucucuuagaaautt

SEQ ID NO: 1216 - DNA, 21 bp, Artificial Sequence
  Description of Artificial Sequence: Synthetic oligonucleotide
  Description of Combined DNA/RNA Molecule: Synthetic oligonucleotide
ucccagaaccagggaggcatt

SEQ ID NO: 1217 - DNA, 21 bp, Artificial Sequence
  Description of Artificial Sequence: Synthetic oligonucleotide
  Description of Combined DNA/RNA Molecule: Synthetic oligonucleotide
cuuuugagacccugcuguctt

SEQ ID NO: 1218 - DNA, 21 bp, Artificial Sequence
  Description of Artificial Sequence: Synthetic oligonucleotide
  Description of Combined DNA/RNA Molecule: Synthetic oligonucleotide
cugucccagaaccagggagtt

SEQ ID NO: 1219 - DNA, 21 bp, Artificial Sequence
  Description of Artificial Sequence: Synthetic oligonucleotide
  Description of Combined DNA/RNA Molecule: Synthetic oligonucleotide
ugucccagaaccagggaggtt

SEQ ID NO: 1220 - DNA, 21 bp, Artificial Sequence
  Description of Artificial Sequence: Synthetic oligonucleotide
  Description of Combined DNA/RNA Molecule: Synthetic oligonucleotide
aagccuuuugagacccugctt

SEQ ID NO: 1221 - DNA, 21 bp, Artificial Sequence
  Description of Artificial Sequence: Synthetic oligonucleotide
  Description of Combined DNA/RNA Molecule: Synthetic oligonucleotide
uugagacccugcugucccatt

SEQ ID NO: 1222 - DNA, 21 bp, Artificial Sequence
  Description of Artificial Sequence: Synthetic oligonucleotide
  Description of Combined DNA/RNA Molecule: Synthetic oligonucleotide
uuuugagacccugcugucctt

SEQ ID NO: 1223 - DNA, 21 bp, Artificial Sequence
  Description of Artificial Sequence: Synthetic oligonucleotide
  Description of Combined DNA/RNA Molecule: Synthetic oligonucleotide
gagacccugcugucccagatt

SEQ ID NO: 1224 - DNA, 21 bp, Artificial Sequence
  Description of Artificial Sequence: Synthetic oligonucleotide
  Description of Combined DNA/RNA Molecule: Synthetic oligonucleotide
gcuggaaggaggagguggutt

SEQ ID NO: 1225 - DNA, 21 bp, Artificial Sequence
  Description of Artificial Sequence: Synthetic oligonucleotide
  Description of Combined DNA/RNA Molecule: Synthetic oligonucleotide
cuggaaggaggagguggugtt

SEQ ID NO: 1226 - DNA, 21 bp, Artificial Sequence
  Description of Artificial Sequence: Synthetic oligonucleotide
  Description of Combined DNA/RNA Molecule: Synthetic oligonucleotide
ucagggccagagcuggaagtt

SEQ ID NO: 1227 - DNA, 21 bp, Artificial Sequence
  Description of Artificial Sequence: Synthetic oligonucleotide
  Description of Combined DNA/RNA Molecule: Synthetic oligonucleotide
ugagacccugcugucccagtt

SEQ ID NO: 1228 - DNA, 21 bp, Artificial Sequence
  Description of Artificial Sequence: Synthetic oligonucleotide
  Description of Combined DNA/RNA Molecule: Synthetic oligonucleotide
agggccagagcuggaaggatt

SEQ ID NO: 1229 - DNA, 21 bp, Artificial Sequence
  Description of Artificial Sequence: Synthetic oligonucleotide
  Description of Combined DNA/RNA Molecule: Synthetic oligonucleotide
agcuggaaggaggagguggtt

SEQ ID NO: 1230 - DNA, 21 bp, Artificial Sequence
  Description of Artificial Sequence: Synthetic oligonucleotide
  Description of Combined DNA/RNA Molecule: Synthetic oligonucleotide
agacccugcugucccagaatt

SEQ ID NO: 1231 - DNA, 21 bp, Artificial Sequence
  Description of Artificial Sequence: Synthetic oligonucleotide
  Description of Combined DNA/RNA Molecule: Synthetic oligonucleotide
gagcuggaaggaggaggugtt

SEQ ID NO: 1232 - DNA, 21 bp, Artificial Sequence
  Description of Artificial Sequence: Synthetic oligonucleotide
  Description of Combined DNA/RNA Molecule: Synthetic oligonucleotide
ugcugucccagaaccagggtt

SEQ ID NO: 1233 - DNA, 21 bp, Artificial Sequence
  Description of Artificial Sequence: Synthetic oligonucleotide
  Description of Combined DNA/RNA Molecule: Synthetic oligonucleotide
cccagaaccagggaggcaatt

SEQ ID NO: 1234 - DNA, 21 bp, Artificial Sequence
  Description of Artificial Sequence: Synthetic oligonucleotide
  Description of Combined DNA/RNA Molecule: Synthetic oligonucleotide
ccagaaccagggaggcaagtt

SEQ ID NO: 1235 - DNA, 21 bp, Artificial Sequence
  Description of Artificial Sequence: Synthetic oligonucleotide
  Description of Combined DNA/RNA Molecule: Synthetic oligonucleotide
uuugagacccugcuguccctt

SEQ ID NO: 1236 - DNA, 21 bp, Artificial Sequence
  Description of Artificial Sequence: Synthetic oligonucleotide
  Description of Combined DNA/RNA Molecule: Synthetic oligonucleotide
gacccugcugucccagaactt

SEQ ID NO: 1237 - DNA, 21 bp, Artificial Sequence
  Description of Artificial Sequence: Synthetic oligonucleotide
  Description of Combined DNA/RNA Molecule: Synthetic oligonucleotide
gaucagggccagagcuggatt

SEQ ID NO: 1238 - DNA, 21 bp, Artificial Sequence
  Description of Artificial Sequence: Synthetic oligonucleotide
  Description of Combined DNA/RNA Molecule: Synthetic oligonucleotide
agccuuuugagacccugcutt

SEQ ID NO: 1239 - DNA, 21 bp, Artificial Sequence
  Description of Artificial Sequence: Synthetic oligonucleotide
  Description of Combined DNA/RNA Molecule: Synthetic oligonucleotide
gccuuuugagacccugcugtt

SEQ ID NO: 1240 - DNA, 21 bp, Artificial Sequence
  Description of Artificial Sequence: Synthetic oligonucleotide
  Description of Combined DNA/RNA Molecule: Synthetic oligonucleotide
ccuuuugagacccugcugutt

SEQ ID NO: 1241 - DNA, 21 bp, Artificial Sequence
  Description of Artificial Sequence: Synthetic oligonucleotide
  Description of Combined DNA/RNA Molecule: Synthetic oligonucleotide
cgccuuuugagacccugcatt

SEQ ID NO: 1242 - DNA, 21 bp, Artificial Sequence
  Description of Artificial Sequence: Synthetic oligonucleotide
  Description of Combined DNA/RNA Molecule: Synthetic oligonucleotide
ccuacaccguggucuauuutt

SEQ ID NO: 1243 - DNA, 21 bp, Artificial Sequence
  Description of Artificial Sequence: Synthetic oligonucleotide
  Description of Combined DNA/RNA Molecule: Synthetic oligonucleotide
ugugggagaccagaucucctt

SEQ ID NO: 1244 - DNA, 21 bp, Artificial Sequence
  Description of Artificial Sequence: Synthetic oligonucleotide
  Description of Combined DNA/RNA Molecule: Synthetic oligonucleotide
gcgggaggcagaguuugcctt

SEQ ID NO: 1245 - DNA, 21 bp, Artificial Sequence
  Description of Artificial Sequence: Synthetic oligonucleotide
  Description of Combined DNA/RNA Molecule: Synthetic oligonucleotide
ccuuucuccaggaccaauatt

SEQ ID NO: 1246 - DNA, 21 bp, Artificial Sequence
  Description of Artificial Sequence: Synthetic oligonucleotide
  Description of Combined DNA/RNA Molecule: Synthetic oligonucleotide
acccugcugucccagaacctt

SEQ ID NO: 1247 - DNA, 21 bp, Artificial Sequence
  Description of Artificial Sequence: Synthetic oligonucleotide
  Description of Combined DNA/RNA Molecule: Synthetic oligonucleotide
ggucuauuucccaguucgatt

SEQ ID NO: 1248 - DNA, 21 bp, Artificial Sequence
  Description of Artificial Sequence: Synthetic oligonucleotide
  Description of Combined DNA/RNA Molecule: Synthetic oligonucleotide
cccugguggacauggugaatt

SEQ ID NO: 1249 - DNA, 21 bp, Artificial Sequence
  Description of Artificial Sequence: Synthetic oligonucleotide
  Description of Combined DNA/RNA Molecule: Synthetic oligonucleotide
acaucucccucaucuacactt

SEQ ID NO: 1250 - DNA, 21 bp, Artificial Sequence
  Description of Artificial Sequence: Synthetic oligonucleotide
  Description of Combined DNA/RNA Molecule: Synthetic oligonucleotide
gcaaggaugacuaugugaatt

SEQ ID NO: 1251 - DNA, 21 bp, Artificial Sequence
  Description of Artificial Sequence: Synthetic oligonucleotide
  Description of Combined DNA/RNA Molecule: Synthetic oligonucleotide
ccuucgcugacuacaaccutt

SEQ ID NO: 1252 - DNA, 21 bp, Artificial Sequence
  Description of Artificial Sequence: Synthetic oligonucleotide
  Description of Combined DNA/RNA Molecule: Synthetic oligonucleotide
cuggcagaucagggccagatt

SEQ ID NO: 1253 - DNA, 21 bp, Artificial Sequence
  Description of Artificial Sequence: Synthetic oligonucleotide
  Description of Combined DNA/RNA Molecule: Synthetic oligonucleotide
gacggagaccucacccugutt

SEQ ID NO: 1254 - DNA, 21 bp, Artificial Sequence
  Description of Artificial Sequence: Synthetic oligonucleotide
  Description of Combined DNA/RNA Molecule: Synthetic oligonucleotide
cgggcaaggaugacuaugutt

SEQ ID NO: 1255 - DNA, 21 bp, Artificial Sequence
  Description of Artificial Sequence: Synthetic oligonucleotide
  Description of Combined DNA/RNA Molecule: Synthetic oligonucleotide
cuuuugagacccugcuguatt

SEQ ID NO: 1256 - DNA, 21 bp, Artificial Sequence
  Description of Artificial Sequence: Synthetic oligonucleotide
  Description of Combined DNA/RNA Molecule: Synthetic oligonucleotide
gagcuggaaggaggagguatt

SEQ ID NO: 1257 - DNA, 21 bp, Artificial Sequence
  Description of Artificial Sequence: Synthetic oligonucleotide
  Description of Combined DNA/RNA Molecule: Synthetic oligonucleotide
acccugcugucccagaacatt

SEQ ID NO: 1258 - DNA, 21 bp, Artificial Sequence
  Description of Artificial Sequence: Synthetic oligonucleotide
  Description of Combined DNA/RNA Molecule: Synthetic oligonucleotide
ugcugucccagaaccaggatt

SEQ ID NO: 1259 - DNA, 21 bp, Artificial Sequence
  Description of Artificial Sequence: Synthetic oligonucleotide
  Description of Combined DNA/RNA Molecule: Synthetic oligonucleotide
agccuuuugagacccugcatt

SEQ ID NO: 1260 - DNA, 21 bp, Artificial Sequence
  Description of Artificial Sequence: Synthetic oligonucleotide
  Description of Combined DNA/RNA Molecule: Synthetic oligonucleotide
ccuuuugagacccugcugatt

SEQ ID NO: 1261 - DNA, 21 bp, Artificial Sequence
  Description of Artificial Sequence: Synthetic oligonucleotide
  Description of Combined DNA/RNA Molecule: Synthetic oligonucleotide
ugaagccuuuugagacccutt

SEQ ID NO: 1262 - DNA, 21 bp, Artificial Sequence
  Description of Artificial Sequence: Synthetic oligonucleotide
  Description of Combined DNA/RNA Molecule: Synthetic oligonucleotide
acugaagccuuuugagacctt

SEQ ID NO: 1263 - DNA, 21 bp, Artificial Sequence
  Description of Artificial Sequence: Synthetic oligonucleotide
  Description of Combined DNA/RNA Molecule: Synthetic oligonucleotide
aaggaugacuaugugaaggtt

SEQ ID NO: 1264 - DNA, 21 bp, Artificial Sequence
  Description of Artificial Sequence: Synthetic oligonucleotide
  Description of Combined DNA/RNA Molecule: Synthetic oligonucleotide
aggaugacuaugugaaggctt

SEQ ID NO: 1265 - DNA, 21 bp, Artificial Sequence
  Description of Artificial Sequence: Synthetic oligonucleotide
  Description of Combined DNA/RNA Molecule: Synthetic oligonucleotide
ggaugacuaugugaaggcatt

SEQ ID NO: 1266 - DNA, 21 bp, Artificial Sequence
  Description of Artificial Sequence: Synthetic oligonucleotide
  Description of Combined DNA/RNA Molecule: Synthetic oligonucleotide
cucccucaucuacaccaactt

SEQ ID NO: 1267 - DNA, 21 bp, Artificial Sequence
  Description of Artificial Sequence: Synthetic oligonucleotide
  Description of Combined DNA/RNA Molecule: Synthetic oligonucleotide
gaagccuuuugagacccugtt

SEQ ID NO: 1268 - DNA, 21 bp, Artificial Sequence
  Description of Artificial Sequence: Synthetic oligonucleotide
  Description of Combined DNA/RNA Molecule: Synthetic oligonucleotide
ucucccucaucuacaccaatt

SEQ ID NO: 1269 - DNA, 21 bp, Artificial Sequence
  Description of Artificial Sequence: Synthetic oligonucleotide
  Description of Combined DNA/RNA Molecule: Synthetic oligonucleotide
ccucaucuacaccaacuautt

SEQ ID NO: 1270 - DNA, 21 bp, Artificial Sequence
  Description of Artificial Sequence: Synthetic oligonucleotide
  Description of Combined DNA/RNA Molecule: Synthetic oligonucleotide
cccucaucuacaccaacuatt

SEQ ID NO: 1271 - DNA, 21 bp, Artificial Sequence
  Description of Artificial Sequence: Synthetic oligonucleotide
  Description of Combined DNA/RNA Molecule: Synthetic oligonucleotide
caacugaagccuuuugagatt

SEQ ID NO: 1272 - DNA, 21 bp, Artificial Sequence
  Description of Artificial Sequence: Synthetic oligonucleotide
  Description of Combined DNA/RNA Molecule: Synthetic oligonucleotide
aacugaagccuuuugagactt

SEQ ID NO: 1273 - DNA, 21 bp, Artificial Sequence
  Description of Artificial Sequence: Synthetic oligonucleotide
  Description of Combined DNA/RNA Molecule: Synthetic oligonucleotide
cugaagccuuuugagaccctt

SEQ ID NO: 1274 - DNA, 21 bp, Artificial Sequence
  Description of Artificial Sequence: Synthetic oligonucleotide
  Description of Combined DNA/RNA Molecule: Synthetic oligonucleotide
ucccucaucuacaccaacutt

SEQ ID NO: 1275 - DNA, 21 bp, Artificial Sequence
  Description of Artificial Sequence: Synthetic oligonucleotide
  Description of Combined DNA/RNA Molecule: Synthetic oligonucleotide
gcucccucaucuacaccaatt

SEQ ID NO: 1276 - DNA, 21 bp, Artificial Sequence
  Description of Artificial Sequence: Synthetic oligonucleotide
  Description of Combined DNA/RNA Molecule: Synthetic oligonucleotide
gaagccuuuugagacccuatt

SEQ ID NO: 1277 - DNA, 21 bp, Artificial Sequence
  Description of Artificial Sequence: Synthetic oligonucleotide
  Description of Combined DNA/RNA Molecule: Synthetic oligonucleotide
acugaagccuuuugagacatt

SEQ ID NO: 1278 - DNA, 21 bp, Artificial Sequence
  Description of Artificial Sequence: Synthetic oligonucleotide
  Description of Combined DNA/RNA Molecule: Synthetic oligonucleotide
cucccucaucuacaccaaatt

SEQ ID NO: 1279 - DNA, 21 bp, Artificial Sequence
  Description of Artificial Sequence: Synthetic oligonucleotide
  Description of Combined DNA/RNA Molecule: Synthetic oligonucleotide
ccucaucuacaccaacuaatt

SEQ ID NO: 1280 - DNA, 21 bp, Artificial Sequence
  Description of Artificial Sequence: Synthetic oligonucleotide
  Description of Combined DNA/RNA Molecule: Synthetic oligonucleotide
accaauaaaauuucuaagatt

SEQ ID NO: 1281 - DNA, 21 bp, Artificial Sequence
  Description of Artificial Sequence: Synthetic oligonucleotide
  Description of Combined DNA/RNA Molecule: Synthetic oligonucleotide
ugccucccugguucugggaca

SEQ ID NO: 1282 - DNA, 21 bp, Artificial Sequence
  Description of Artificial Sequence: Synthetic oligonucleotide
  Description of Combined DNA/RNA Molecule: Synthetic oligonucleotide
gacagcagggucucaaaaggc

SEQ ID NO: 1283 - DNA, 21 bp, Artificial Sequence
  Description of Artificial Sequence: Synthetic oligonucleotide
  Description of Combined DNA/RNA Molecule: Synthetic oligonucleotide
cucccugguucugggacagca

SEQ ID NO: 1284 - DNA, 21 bp, Artificial Sequence
  Description of Artificial Sequence: Synthetic oligonucleotide
  Description of Combined DNA/RNA Molecule: Synthetic oligonucleotide
ccucccugguucugggacagc

SEQ ID NO: 1285 - DNA, 21 bp, Artificial Sequence
  Description of Artificial Sequence: Synthetic oligonucleotide
  Description of Combined DNA/RNA Molecule: Synthetic oligonucleotide
gcagggucucaaaaggcuuca

SEQ ID NO: 1286 - DNA, 21 bp, Artificial Sequence
  Description of Artificial Sequence: Synthetic oligonucleotide
  Description of Combined DNA/RNA Molecule: Synthetic oligonucleotide
ugggacagcagggucucaaaa

SEQ ID NO: 1287 - DNA, 21 bp, Artificial Sequence
  Description of Artificial Sequence: Synthetic oligonucleotide
  Description of Combined DNA/RNA Molecule: Synthetic oligonucleotide
ggacagcagggucucaaaagg

SEQ ID NO: 1288 - DNA, 21 bp, Artificial Sequence
  Description of Artificial Sequence: Synthetic oligonucleotide
  Description of Combined DNA/RNA Molecule: Synthetic oligonucleotide
ucugggacagcagggucucaa

SEQ ID NO: 1289 - DNA, 21 bp, Artificial Sequence
  Description of Artificial Sequence: Synthetic oligonucleotide
  Description of Combined DNA/RNA Molecule: Synthetic oligonucleotide
accaccuccuccuuccagctc

SEQ ID NO: 1290 - DNA, 21 bp, Artificial Sequence
  Description of Artificial Sequence: Synthetic oligonucleotide
  Description of Combined DNA/RNA Molecule: Synthetic oligonucleotide
caccaccuccuccuuccagct

SEQ ID NO: 1291 - DNA, 21 bp, Artificial Sequence
  Description of Artificial Sequence: Synthetic oligonucleotide
  Description of Combined DNA/RNA Molecule: Synthetic oligonucleotide
cuuccagcucuggcccugatc

SEQ ID NO: 1292 - DNA, 21 bp, Artificial Sequence
  Description of Artificial Sequence: Synthetic oligonucleotide
  Description of Combined DNA/RNA Molecule: Synthetic oligonucleotide
cugggacagcagggucucaaa

SEQ ID NO: 1293 - DNA, 21 bp, Artificial Sequence
  Description of Artificial Sequence: Synthetic oligonucleotide
  Description of Combined DNA/RNA Molecule: Synthetic oligonucleotide
uccuuccagcucuggcccuga

SEQ ID NO: 1294 - DNA, 21 bp, Artificial Sequence
  Description of Artificial Sequence: Synthetic oligonucleotide
  Description of Combined DNA/RNA Molecule: Synthetic oligonucleotide
ccaccuccuccuuccagcuct

SEQ ID NO: 1295 - DNA, 21 bp, Artificial Sequence
  Description of Artificial Sequence: Synthetic oligonucleotide
  Description of Combined DNA/RNA Molecule: Synthetic oligonucleotide
uucugggacagcagggucuca

SEQ ID NO: 1296 - DNA, 21 bp, Artificial Sequence
  Description of Artificial Sequence: Synthetic oligonucleotide
  Description of Combined DNA/RNA Molecule: Synthetic oligonucleotide
caccuccuccuuccagcuctg

SEQ ID NO: 1297 - DNA, 21 bp, Artificial Sequence
  Description of Artificial Sequence: Synthetic oligonucleotide
  Description of Combined DNA/RNA Molecule: Synthetic oligonucleotide
cccugguucugggacagcagg

SEQ ID NO: 1298 - DNA, 21 bp, Artificial Sequence
  Description of Artificial Sequence: Synthetic oligonucleotide
  Description of Combined DNA/RNA Molecule: Synthetic oligonucleotide
uugccucccugguucugggac

SEQ ID NO: 1299 - DNA, 21 bp, Artificial Sequence
  Description of Artificial Sequence: Synthetic oligonucleotide
  Description of Combined DNA/RNA Molecule: Synthetic oligonucleotide
cuugccucccugguucuggga

SEQ ID NO: 1300 - DNA, 21 bp, Artificial Sequence
  Description of Artificial Sequence: Synthetic oligonucleotide
  Description of Combined DNA/RNA Molecule: Synthetic oligonucleotide
gggacagcagggucucaaaag

SEQ ID NO: 1301 - DNA, 21 bp, Artificial Sequence
  Description of Artificial Sequence: Synthetic oligonucleotide
  Description of Combined DNA/RNA Molecule: Synthetic oligonucleotide
guucugggacagcaggguctc

SEQ ID NO: 1302 - DNA, 21 bp, Artificial Sequence
  Description of Artificial Sequence: Synthetic oligonucleotide
  Description of Combined DNA/RNA Molecule: Synthetic oligonucleotide
uccagcucuggcccugauctg

SEQ ID NO: 1303 - DNA, 21 bp, Artificial Sequence
  Description of Artificial Sequence: Synthetic oligonucleotide
  Description of Combined DNA/RNA Molecule: Synthetic oligonucleotide
agcagggucucaaaaggcutc

SEQ ID NO: 1304 - DNA, 21 bp, Artificial Sequence
  Description of Artificial Sequence: Synthetic oligonucleotide
  Description of Combined DNA/RNA Molecule: Synthetic oligonucleotide
cagcagggucucaaaaggctt

SEQ ID NO: 1305 - DNA, 21 bp, Artificial Sequence
  Description of Artificial Sequence: Synthetic oligonucleotide
  Description of Combined DNA/RNA Molecule: Synthetic oligonucleotide
acagcagggucucaaaaggct

SEQ ID NO: 1306 - DNA, 21 bp, Artificial Sequence
  Description of Artificial Sequence: Synthetic oligonucleotide
  Description of Combined DNA/RNA Molecule: Synthetic oligonucleotide
ugcagggucucaaaaggcgtc

SEQ ID NO: 1307 - DNA, 21 bp, Artificial Sequence
  Description of Artificial Sequence: Synthetic oligonucleotide
  Description of Combined DNA/RNA Molecule: Synthetic oligonucleotide
aaauagaccacgguguagggc

SEQ ID NO: 1308 - DNA, 21 bp, Artificial Sequence
  Description of Artificial Sequence: Synthetic oligonucleotide
  Description of Combined DNA/RNA Molecule: Synthetic oligonucleotide
ggagaucuggucucccacaat

SEQ ID NO: 1309 - DNA, 21 bp, Artificial Sequence
  Description of Artificial Sequence: Synthetic oligonucleotide
  Description of Combined DNA/RNA Molecule: Synthetic oligonucleotide
ggcaaacucugccucccgctc

SEQ ID NO: 1310 - DNA, 21 bp, Artificial Sequence
  Description of Artificial Sequence: Synthetic oligonucleotide
  Description of Combined DNA/RNA Molecule: Synthetic oligonucleotide
uauugguccuggagaaaggaa

SEQ ID NO: 1311 - DNA, 21 bp, Artificial Sequence
  Description of Artificial Sequence: Synthetic oligonucleotide
  Description of Combined DNA/RNA Molecule: Synthetic oligonucleotide
gguucugggacagcaggguct

SEQ ID NO: 1312 - DNA, 21 bp, Artificial Sequence
  Description of Artificial Sequence: Synthetic oligonucleotide
  Description of Combined DNA/RNA Molecule: Synthetic oligonucleotide
ucgaacugggaaauagaccac

SEQ ID NO: 1313 - DNA, 21 bp, Artificial Sequence
  Description of Artificial Sequence: Synthetic oligonucleotide
  Description of Combined DNA/RNA Molecule: Synthetic oligonucleotide
uucaccauguccaccagggct

SEQ ID NO: 1314 - DNA, 21 bp, Artificial Sequence
  Description of Artificial Sequence: Synthetic oligonucleotide
  Description of Combined DNA/RNA Molecule: Synthetic oligonucleotide
guguagaugagggagauguat

SEQ ID NO: 1315 - DNA, 21 bp, Artificial Sequence
  Description of Artificial Sequence: Synthetic oligonucleotide
  Description of Combined DNA/RNA Molecule: Synthetic oligonucleotide
uucacauagucauccuugccc

SEQ ID NO: 1316 - DNA, 21 bp, Artificial Sequence
  Description of Artificial Sequence: Synthetic oligonucleotide
  Description of Combined DNA/RNA Molecule: Synthetic oligonucleotide
agguuguagucagcgaaggag

SEQ ID NO: 1317 - DNA, 21 bp, Artificial Sequence
  Description of Artificial Sequence: Synthetic oligonucleotide
  Description of Combined DNA/RNA Molecule: Synthetic oligonucleotide
ucuggcccugaucugccagca

SEQ ID NO: 1318 - DNA, 21 bp, Artificial Sequence
  Description of Artificial Sequence: Synthetic oligonucleotide
  Description of Combined DNA/RNA Molecule: Synthetic oligonucleotide
acagggugaggucuccgucct

SEQ ID NO: 1319 - DNA, 21 bp, Artificial Sequence
  Description of Artificial Sequence: Synthetic oligonucleotide
  Description of Combined DNA/RNA Molecule: Synthetic oligonucleotide
acauagucauccuugcccgcc

SEQ ID NO: 1320 - DNA, 21 bp, Artificial Sequence
  Description of Artificial Sequence: Synthetic oligonucleotide
  Description of Combined DNA/RNA Molecule: Synthetic oligonucleotide
uacagcagggucucaaaaggc

SEQ ID NO: 1321 - DNA, 21 bp, Artificial Sequence
  Description of Artificial Sequence: Synthetic oligonucleotide
  Description of Combined DNA/RNA Molecule: Synthetic oligonucleotide
uaccuccuccuuccagcuctg

SEQ ID NO: 1322 - DNA, 21 bp, Artificial Sequence
  Description of Artificial Sequence: Synthetic oligonucleotide
  Description of Combined DNA/RNA Molecule: Synthetic oligonucleotide
uguucugggacagcaggguct

SEQ ID NO: 1323 - DNA, 21 bp, Artificial Sequence
  Description of Artificial Sequence: Synthetic oligonucleotide
  Description of Combined DNA/RNA Molecule: Synthetic oligonucleotide
uccugguucugggacagcagg

SEQ ID NO: 1324 - DNA, 21 bp, Artificial Sequence
  Description of Artificial Sequence: Synthetic oligonucleotide
  Description of Combined DNA/RNA Molecule: Synthetic oligonucleotide
ugcagggucucaaaaggcutc

SEQ ID NO: 1325 - DNA, 21 bp, Artificial Sequence
  Description of Artificial Sequence: Synthetic oligonucleotide
  Description of Combined DNA/RNA Molecule: Synthetic oligonucleotide
ucagcagggucucaaaaggct

SEQ ID NO: 1326 - DNA, 21 bp, Artificial Sequence
  Description of Artificial Sequence: Synthetic oligonucleotide
  Description of Combined DNA/RNA Molecule: Synthetic oligonucleotide
agggucucaaaaggcuucagt

SEQ ID NO: 1327 - DNA, 21 bp, Artificial Sequence
  Description of Artificial Sequence: Synthetic oligonucleotide
  Description of Combined DNA/RNA Molecule: Synthetic oligonucleotide
ggucucaaaaggcuucagutg

SEQ ID NO: 1328 - DNA, 21 bp, Artificial Sequence
  Description of Artificial Sequence: Synthetic oligonucleotide
  Description of Combined DNA/RNA Molecule: Synthetic oligonucleotide
ccuucacauagucauccuugc

SEQ ID NO: 1329 - DNA, 21 bp, Artificial Sequence
  Description of Artificial Sequence: Synthetic oligonucleotide
  Description of Combined DNA/RNA Molecule: Synthetic oligonucleotide
gccuucacauagucauccutg

SEQ ID NO: 1330 - DNA, 21 bp, Artificial Sequence
  Description of Artificial Sequence: Synthetic oligonucleotide
  Description of Combined DNA/RNA Molecule: Synthetic oligonucleotide
ugccuucacauagucaucctt

SEQ ID NO: 1331 - DNA, 21 bp, Artificial Sequence
  Description of Artificial Sequence: Synthetic oligonucleotide
  Description of Combined DNA/RNA Molecule: Synthetic oligonucleotide
guugguguagaugagggagat

SEQ ID NO: 1332 - DNA, 21 bp, Artificial Sequence
  Description of Artificial Sequence: Synthetic oligonucleotide
  Description of Combined DNA/RNA Molecule: Synthetic oligonucleotide
cagggucucaaaaggcuucag

SEQ ID NO: 1333 - DNA, 21 bp, Artificial Sequence
  Description of Artificial Sequence: Synthetic oligonucleotide
  Description of Combined DNA/RNA Molecule: Synthetic oligonucleotide
uugguguagaugagggagatg

SEQ ID NO: 1334 - DNA, 21 bp, Artificial Sequence
  Description of Artificial Sequence: Synthetic oligonucleotide
  Description of Combined DNA/RNA Molecule: Synthetic oligonucleotide
auaguugguguagaugaggga

SEQ ID NO: 1335 - DNA, 21 bp, Artificial Sequence
  Description of Artificial Sequence: Synthetic oligonucleotide
  Description of Combined DNA/RNA Molecule: Synthetic oligonucleotide
uaguugguguagaugagggag

SEQ ID NO: 1336 - DNA, 21 bp, Artificial Sequence
  Description of Artificial Sequence: Synthetic oligonucleotide
  Description of Combined DNA/RNA Molecule: Synthetic oligonucleotide
ucucaaaaggcuucaguugcc

SEQ ID NO: 1337 - DNA, 21 bp, Artificial Sequence
  Description of Artificial Sequence: Synthetic oligonucleotide
  Description of Combined DNA/RNA Molecule: Synthetic oligonucleotide
gucucaaaaggcuucaguugc

SEQ ID NO: 1338 - DNA, 21 bp, Artificial Sequence
  Description of Artificial Sequence: Synthetic oligonucleotide
  Description of Combined DNA/RNA Molecule: Synthetic oligonucleotide
gggucucaaaaggcuucagtt

SEQ ID NO: 1339 - DNA, 21 bp, Artificial Sequence
  Description of Artificial Sequence: Synthetic oligonucleotide
  Description of Combined DNA/RNA Molecule: Synthetic oligonucleotide
aguugguguagaugagggaga

SEQ ID NO: 1340 - DNA, 21 bp, Artificial Sequence
  Description of Artificial Sequence: Synthetic oligonucleotide
  Description of Combined DNA/RNA Molecule: Synthetic oligonucleotide
uugguguagaugagggagctg

SEQ ID NO: 1341 - DNA, 21 bp, Artificial Sequence
  Description of Artificial Sequence: Synthetic oligonucleotide
  Description of Combined DNA/RNA Molecule: Synthetic oligonucleotide
uagggucucaaaaggcuucag

SEQ ID NO: 1342 - DNA, 21 bp, Artificial Sequence
  Description of Artificial Sequence: Synthetic oligonucleotide
  Description of Combined DNA/RNA Molecule: Synthetic oligonucleotide
ugucucaaaaggcuucagutg

SEQ ID NO: 1343 - DNA, 21 bp, Artificial Sequence
  Description of Artificial Sequence: Synthetic oligonucleotide
  Description of Combined DNA/RNA Molecule: Synthetic oligonucleotide
uuugguguagaugagggagat

SEQ ID NO: 1344 - DNA, 21 bp, Artificial Sequence
  Description of Artificial Sequence: Synthetic oligonucleotide
  Description of Combined DNA/RNA Molecule: Synthetic oligonucleotide
uuaguugguguagaugaggga

SEQ ID NO: 1345 - DNA, 21 bp, Artificial Sequence
  Description of Artificial Sequence: Synthetic oligonucleotide
  Description of Combined DNA/RNA Molecule: Synthetic oligonucleotide
ucuuagaaauuuuauuggucc

SEQ ID NO: 1346 - RNA, 21 nt, Artificial Sequence
  Description of Artificial Sequence: Synthetic oligonucleotide
  modified_base (20)..(20): a, c, u, g, unknown or other
  modified_base (21)..(21): a, c, u, g, unknown or other
gaagccuuuugagacccuann

SEQ ID NO: 1347 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1348 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1349 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1350 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1351 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1352 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1353 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1354 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1355 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1356 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1357 - DNA, 21 bp, Artificial Sequence
  Description of Artificial Sequence: Synthetic oligonucleotide
  Description of Combined DNA/RNA Molecule: Synthetic oligonucleotide
gaagccuuuugagacccuatt

SEQ ID NO: 1358 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1359 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1360 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1361 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuauu

SEQ ID NO: 1362 - DNA, 21 bp, Artificial Sequence
  Description of Artificial Sequence: Synthetic oligonucleotide
  Description of Combined DNA/RNA Molecule: Synthetic oligonucleotide
  modified_base (19)..(19): 2'-deoxy-2'-fluoro-nucleotide
  modified_base (20)..(20): 2'-OMe-nucleotide
  modified_base (21)..(21): 2'-OMe-nucleotide
gaagccuuuugagacccuauu

SEQ ID NO: 1363 - DNA, 21 bp, Artificial Sequence
  Description of Artificial Sequence: Synthetic oligonucleotide
  Description of Combined DNA/RNA Molecule: Synthetic oligonucleotide
  modified_base (14)..(14): 2'-deoxy-2'-fluoro-nucleotide
  modified_base (19)..(19): 2'-deoxy-2'-fluoro-nucleotide
  modified_base (20)..(20): 2'-OMe-nucleotide
  modified_base (21)..(21): 2'-OMe-nucleotide
gaagccuuuugagacccuauu

SEQ ID NO: 1364 - RNA, 21 nt, Artificial Sequence
  Description of Artificial Sequence: Synthetic oligonucleotide
  modified_base (19)..(19): 2'-OMe-nucleotide
  modified_base (20)..(20): 2'-OMe-nucleotide
  modified_base (21)..(21): 2'-OMe-nucleotide
gaagccuuuugagacccuauu

SEQ ID NO: 1365 - RNA, 21 nt, Artificial Sequence
  Description of Artificial Sequence: Synthetic oligonucleotide
  modified_base (19)..(19): 2'-OMe-nucleotide
  modified_base (20)..(20): 2'-OMe-nucleotide
  modified_base (21)..(21): 2'-OMe-nucleotide
gaagccuuuugagacccuauu

SEQ ID NO: 1366 - RNA, 21 nt, Artificial Sequence
  Description of Artificial Sequence: Synthetic oligonucleotide
  modified_base (1)..(1): 2'-OMe-nucleotide
  modified_base (2)..(2): 2'-OMe-nucleotide
  modified_base (3)..(3): 2'-OMe-nucleotide
  modified_base (20)..(20): 2'-OMe-nucleotide
  modified_base (21)..(21): 2'-OMe-nucleotide
gaagccuuuugagacccuauu

SEQ ID NO: 1367 - RNA, 21 nt, Artificial Sequence
  Description of Artificial Sequence: Synthetic oligonucleotide
  modified_base (1)..(1): 2'-OMe-nucleotide
  modified_base (2)..(2): 2'-OMe-nucleotide
  modified_base (3)..(3): 2'-OMe-nucleotide
  modified_base (8)..(8): 2'-OMe-nucleotide
  modified_base (10)..(10): 2'-OMe-nucleotide
  modified_base (18)..(18): 2'-OMe-nucleotide
  modified_base (20)..(20): 2'-OMe-nucleotide
  modified_base (21)..(21): 2'-OMe-nucleotide
gaagccuuuugagacccuauu

SEQ ID NO: 1368 - RNA, 21 nt, Artificial Sequence
  Description of Artificial Sequence: Synthetic oligonucleotide
  modified_base (1)..(1): 2'-OMe-nucleotide
  modified_base (2)..(2): 2'-OMe-nucleotide
  modified_base (3)..(3): 2'-OMe-nucleotide
  modified_base (20)..(20): 2'-OMe-nucleotide
  modified_base (21)..(21): 2'-OMe-nucleotide
gaagccuuuugagacccuauu

SEQ ID NO: 1369 - RNA, 21 nt, Artificial Sequence
  Description of Artificial Sequence: Synthetic oligonucleotide
  modified_base (1)..(1): 2'-OMe-nucleotide
  modified_base (2)..(2): 2'-OMe-nucleotide
  modified_base (3)..(3): 2'-OMe-nucleotide
  modified_base (8)..(8): 2'-OMe-nucleotide
  modified_base (10)..(10): 2'-OMe-nucleotide
  modified_base (18)..(18): 2'-OMe-nucleotide
  modified_base (20)..(20): 2'-OMe-nucleotide
  modified_base (21)..(21): 2'-OMe-nucleotide
gaagccuuuugagacccuauu

SEQ ID NO: 1370 - RNA, 21 nt, Artificial Sequence
  Description of Artificial Sequence: Synthetic oligonucleotide
  modified_base (1)..(1): 2'-OMe-nucleotide
  modified_base (2)..(2): 2'-OMe-nucleotide
  modified_base (3)..(3): 2'-OMe-nucleotide
  modified_base (8)..(8): 2'-OMe-nucleotide
  modified_base (10)..(10): 2'-OMe-nucleotide
  modified_base (18)..(18): 2'-OMe-nucleotide
  modified_base (19)..(19): 2'-OMe-nucleotide
  modified_base (20)..(20): 2'-OMe-nucleotide
  modified_base (21)..(21): 2'-OMe-nucleotide
gaagccuuuugagacccuauu

SEQ ID NO: 1371 - RNA, 21 nt, Artificial Sequence
  Description of Artificial Sequence: Synthetic oligonucleotide
  modified_base (1)..(1): 2'-OMe-nucleotide
  modified_base (2)..(2): 2'-OMe-nucleotide
  modified_base (3)..(3): 2'-OMe-nucleotide
  modified_base (8)..(8): 2'-OMe-nucleotide
  modified_base (10)..(10): 2'-OMe-nucleotide
  modified_base (18)..(18): 2'-OMe-nucleotide
  modified_base (19)..(19): 2'-OMe-nucleotide
  modified_base (20)..(20): 2'-OMe-nucleotide
  modified_base (21)..(21): 2'-OMe-nucleotide
gaagccuuuugagacccuauu

SEQ ID NO: 1372 - RNA, 21 nt, Artificial Sequence
  Description of Artificial Sequence: Synthetic oligonucleotide
  modified_base (20)..(20): a, c, u, g, unknown or other
  modified_base (21)..(21): a, c, u, g, unknown or other
uagggucucaaaaggcuucnn

SEQ ID NO: 1373 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1374 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1375 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1376 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1377 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1378 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1379 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1380 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1381 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1382 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1383 - DNA, 21 bp, Artificial Sequence
  Description of Artificial Sequence: Synthetic oligonucleotide
  Description of Combined DNA/RNA Molecule: Synthetic oligonucleotide
  modified_base (14)..(14): 2'-OMe-nucleotide
  modified_base (16)..(16): 2'-OMe-nucleotide
  modified_base (18)..(18): 2'-OMe-nucleotide
  modified_base (20)..(20): 2'-OMe-nucleotide
  modified_base (21)..(21): 2'-OMe-nucleotide
uagggucucaaaaggcuucuu

SEQ ID NO: 1384 - RNA, 21 nt, Artificial Sequence
  Description of Artificial Sequence: Synthetic oligonucleotide
  modified_base (1)..(1): 2'-OMe-nucleotide
  modified_base (20)..(20): 2'-OMe-nucleotide
  modified_base (21)..(21): 2'-OMe-nucleotide
uagggucucaaaaggcuucuu

SEQ ID NO: 1385 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-deoxy-2'-fluoro-nucleotide
  modified_base (20)..(20): 2'-OMe-nucleotide
  modified_base (21)..(21): 2'-OMe-nucleotide
uagggucucaaaaggcuucuu

SEQ ID NO: 1386 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1387 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1388 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-deoxy-2'-fluoro-nucleotide
  modified_base (9)..(9): 2'-deoxy-2'-fluoro-nucleotide
  modified_base (17)..(17): 2'-deoxy-2'-fluoro-nucleotide
  modified_base (20)..(20): 2'-OMe-nucleotide
  modified_base (21)..(21): 2'-OMe-nucleotide
uagggucucaaaaggcuucuu

SEQ ID NO: 1389 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-deoxy-2'-fluoro-nucleotide
  modified_base (9)..(9): 2'-deoxy-2'-fluoro-nucleotide
  modified_base (11)..(11): 2'-deoxy-2'-fluoro-nucleotide
  modified_base (12)..(12): 2'-deoxy-2'-fluoro-nucleotide
  modified_base (17)..(17): 2'-deoxy-2'-fluoro-nucleotide
  modified_base (20)..(20): 2'-OMe-nucleotide
  modified_base (21)..(21): 2'-OMe-nucleotide
uagggucucaaaaggcuucuu

SEQ ID NO: 1390 - RNA, 21 nt, Artificial Sequence
  Description of Artificial Sequence: Synthetic oligonucleotide
  modified_base (1)..(1): 2'-OMe-nucleotide
  modified_base (9)..(9): 2'-OMe-nucleotide
  modified_base (17)..(17): 2'-OMe-nucleotide
  modified_base (20)..(20): 2'-OMe-nucleotide
  modified_base (21)..(21): 2'-OMe-nucleotide
uagggucucaaaaggcuucuu

SEQ ID NO: 1391 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-deoxy-2'-fluoro-nucleotide
  modified_base (9)..(9): 2'-OMe-nucleotide
  modified_base (17)..(17): 2'-OMe-nucleotide
  modified_base (20)..(20): 2'-OMe-nucleotide
  modified_base (21)..(21): 2'-OMe-nucleotide
uagggucucaaaaggcuucuu

SEQ ID NO: 1392 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1393 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
uagggucucaaaaggcuucuu

SEQ ID NO: 1394 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-OMe-nucleotide
  modified_base (9)..(9): 2'-OMe-nucleotide
  modified_base (11)..(11): 2'-OMe-nucleotide
  modified_base (12)..(12): 2'-OMe-nucleotide
  modified_base (18)..(18): 2'-OMe-nucleotide
  modified_base (20)..(20): 2'-OMe-nucleotide
  modified_base (21)..(21): 2'-OMe-nucleotide
uagggucucaaaaggcuucuu

SEQ ID NO: 1395 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-OMe-nucleotide
  modified_base (9)..(9): 2'-OMe-nucleotide
  modified_base (11)..(11): 2'-OMe-nucleotide
  modified_base (12)..(12): 2'-OMe-nucleotide
  modified_base (18)..(18): 2'-OMe-nucleotide
  modified_base (20)..(20): 2'-OMe-nucleotide
  modified_base (21)..(21): 2'-OMe-nucleotide
uagggucucaaaaggcuucuu

SEQ ID NO: 1396 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-OMe-nucleotide
  modified_base (9)..(9): 2'-OMe-nucleotide
  modified_base (11)..(11): 2'-OMe-nucleotide
  modified_base (12)..(12): 2'-OMe-nucleotide
  modified_base (17)..(17): 2'-OMe-nucleotide
  modified_base (18)..(18): 2'-OMe-nucleotide
  modified_base (20)..(20): 2'-OMe-nucleotide
  modified_base (21)..(21): 2'-OMe-nucleotide
uagggucucaaaaggcuucuu

SEQ ID NO: 1397 - DNA, 21 bp, Artificial Sequence
  Description of Artificial Sequence: Synthetic oligonucleotide
  Description of Combined DNA/RNA Molecule: Synthetic oligonucleotide
  modified_base (1)..(1): 2'-deoxy-2'-fluoro-nucleotide
  modified_base (9)..(9): 2'-OMe-nucleotide
  modified_base (11)..(11): 2'-OMe-nucleotide
  modified_base (12)..(12): 2'-OMe-nucleotide
  modified_base (17)..(17): 2'-OMe-nucleotide
  modified_base (18)..(18): 2'-OMe-nucleotide
  modified_base (20)..(20): 2'-OMe-nucleotide
  modified_base (21)..(21): 2'-OMe-nucleotide
uagggucucaaaaggcuucuu

SEQ ID NO: 1398 - RNA, 21 nt, Artificial Sequence
  Description of Artificial Sequence: Synthetic oligonucleotide
  modified_base (20)..(20): a, c, u, g, unknown or other
  modified_base (21)..(21): a, c, u, g, unknown or other
ccuuuugagacccugcugunn

SEQ ID NO: 1399 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccuuuugagacccugcuguuu

SEQ ID NO: 1400 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccuuuugagacccugcuguuu

SEQ ID NO: 1401 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccuuuugagacccugcuguuu

SEQ ID NO: 1402 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccuuuugagacccugcuguuu

SEQ ID NO: 1403 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccuuuugagacccugcuguuu

SEQ ID NO: 1404 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccuuuugagacccugcuguuu

SEQ ID NO: 1405 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccuuuugagacccugcuguuu

SEQ ID NO: 1406 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccuuuugagacccugcuguuu

SEQ ID NO: 1407 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccuuuugagacccugcuguuu

SEQ ID NO: 1408 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccuuuugagacccugcuguuu

SEQ ID NO: 1409 - RNA, 21 nt, Artificial Sequence
  Description of Artificial Sequence: Synthetic oligonucleotide
  modified_base (1)..(1): 2'-OMe-nucleotide
  modified_base (3)..(3): 2'-OMe-nucleotide
  modified_base (5)..(5): 2'-OMe-nucleotide
  modified_base (7)..(7): 2'-OMe-nucleotide
  modified_base (9)..(9): 2'-OMe-nucleotide
  modified_base (20)..(20): 2'-OMe-nucleotide
  modified_base (21)..(21): 2'-OMe-nucleotide
ccuuuugagacccugcuguuu

SEQ ID NO: 1410 - RNA, 21 nt, Artificial Sequence
  Description of Artificial Sequence: Synthetic oligonucleotide
  modified_base (20)..(20): a, c, u, g, unknown or other
  modified_base (21)..(21): a, c, u, g, unknown or other
acagcagggucucaaaaggnn

SEQ ID NO: 1411 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
acagcagggucucaaaagguu

SEQ ID NO: 1412 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
acagcagggucucaaaagguu

SEQ ID NO: 1413 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
acagcagggucucaaaagguu

SEQ ID NO: 1414 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
acagcagggucucaaaagguu

SEQ ID NO: 1415 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
acagcagggucucaaaagguu

SEQ ID NO: 1416 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
acagcagggucucaaaagguu

SEQ ID NO: 1417 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
acagcagggucucaaaagguu

SEQ ID NO: 1418 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
acagcagggucucaaaagguu

SEQ ID NO: 1419 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
acagcagggucucaaaagguu

SEQ ID NO: 1420 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
acagcagggucucaaaagguu

SEQ ID NO: 1421 - DNA, 21 bp, Artificial Sequence
  Description of Artificial Sequence: Synthetic oligonucleotide
  Description of Combined DNA/RNA Molecule: Synthetic oligonucleotide
  modified_base (14)..(14): 2'-OMe-nucleotide
  modified_base (16)..(16): 2'-OMe-nucleotide
  modified_base (18)..(18): 2'-OMe-nucleotide
  modified_base (20)..(20): 2'-OMe-nucleotide
  modified_base (21)..(21): 2'-OMe-nucleotide
acagcagggucucaaaagguu

SEQ ID NO: 1422 - RNA, 21 nt, Artificial Sequence
  Description of Artificial Sequence: Synthetic oligonucleotide
  modified_base (20)..(20): a, c, u, g, unknown or other
  modified_base (21)..(21): a, c, u, g, unknown or other
ggaugacuaugugaaggcann

SEQ ID NO: 1423 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ggaugacuaugugaaggcauu

SEQ ID NO: 1424 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ggaugacuaugugaaggcauu

SEQ ID NO: 1425 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ggaugacuaugugaaggcauu

SEQ ID NO: 1426 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ggaugacuaugugaaggcauu

SEQ ID NO: 1427 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ggaugacuaugugaaggcauu

SEQ ID NO: 1428 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ggaugacuaugugaaggcauu

SEQ ID NO: 1429 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ggaugacuaugugaaggcauu

SEQ ID NO: 1430 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ggaugacuaugugaaggcauu

SEQ ID NO: 1431 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ggaugacuaugugaaggcauu

SEQ ID NO: 1432 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ggaugacuaugugaaggcauu

SEQ ID NO: 1433 - RNA, 21 nt, Artificial Sequence
  Description of Artificial Sequence: Synthetic oligonucleotide
  modified_base (1)..(1): 2'-OMe-nucleotide
  modified_base (3)..(3): 2'-OMe-nucleotide
  modified_base (5)..(5): 2'-OMe-nucleotide
  modified_base (7)..(7): 2'-OMe-nucleotide
  modified_base (20)..(20): 2'-OMe-nucleotide
  modified_base (21)..(21): 2'-OMe-nucleotide
ggaugacuaugugaaggcauu

SEQ ID NO: 1434 - DNA, 21 bp, Artificial Sequence
  Description of Artificial Sequence: Synthetic oligonucleotide
  Description of Combined DNA/RNA Molecule: Synthetic oligonucleotide
  modified_base (11)..(11): 2'-deoxy-2'-fluoro-nucleotide
  modified_base (13)..(13): 2'-deoxy-2'-fluoro-nucleotide
  modified_base (20)..(20): 2'-OMe-nucleotide
  modified_base (21)..(21): 2'-OMe-nucleotide
ggaugacuaugugaaggcauu

SEQ ID NO: 1435 - RNA, 21 nt, Artificial Sequence
  Description of Artificial Sequence: Synthetic oligonucleotide
  modified_base (1)..(1): 2'-OMe-nucleotide
  modified_base (2)..(2): 2'-OMe-nucleotide
  modified_base (20)..(20): 2'-OMe-nucleotide
  modified_base (21)..(21): 2'-OMe-nucleotide
ggaugacuaugugaaggcauu

SEQ ID NO: 1436 - RNA, 21 nt, Artificial Sequence
  Description of Artificial Sequence: Synthetic oligonucleotide
  modified_base (1)..(1): 2'-OMe-nucleotide
  modified_base (2)..(2): 2'-OMe-nucleotide
  modified_base (20)..(20): 2'-OMe-nucleotide
  modified_base (21)..(21): 2'-OMe-nucleotide
ggaugacuaugugaaggcauu

SEQ ID NO: 1437 - RNA, 21 nt, Artificial Sequence
  Description of Artificial Sequence: Synthetic oligonucleotide
  modified_base (20)..(20): a, c, u, g, unknown or other
  modified_base (21)..(21): a, c, u, g, unknown or other
ugccuucacauagucauccnn

SEQ ID NO: 1438 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ugccuucacauagucauccuu

SEQ ID NO: 1439 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
ugccuucacauagucauccuu

SEQ ID NO: 1440 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
ugccuucacauagucauccuu

SEQ ID NO: 1441 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
ugccuucacauagucauccuu

SEQ ID NO: 1442 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
ugccuucacauagucauccuu

SEQ ID NO: 1443 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
ugccuucacauagucauccuu

SEQ ID NO: 1444 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
ugccuucacauagucauccuu

SEQ ID NO: 1445 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
ugccuucacauagucauccuu

SEQ ID NO: 1446 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
ugccuucacauagucauccuu

SEQ ID NO: 1447 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
ugccuucacauagucauccuu

SEQ ID NO: 1448 - DNA, 21 bp, Artificial Sequence
  Description of Artificial Sequence: Synthetic oligonucleotide
  Description of Combined DNA/RNA Molecule: Synthetic oligonucleotide
  modified_base (14)..(14): 2'-OMe-nucleotide
  modified_base (16)..(16): 2'-OMe-nucleotide
  modified_base (18)..(18): 2'-OMe-nucleotide
  modified_base (20)..(20): 2'-OMe-nucleotide
  modified_base (21)..(21): 2'-OMe-nucleotide
ugccuucacauagucauccuu

SEQ ID NO: 1449 - DNA, 21 bp, Artificial Sequence
  Description of Artificial Sequence: Synthetic oligonucleotide
  Description of Combined DNA/RNA Molecule: Synthetic oligonucleotide
  modified_base (4)..(4): 2'-deoxy-2'-fluoro-nucleotide
  modified_base (20)..(20): 2'-OMe-nucleotide
  modified_base (21)..(21): 2'-OMe-nucleotide
ugccuucacauagucauccuu

SEQ ID NO: 1450 - RNA, 21 nt, Artificial Sequence
  Description of Artificial Sequence: Synthetic oligonucleotide
  modified_base (9)..(9): 2'-OMe-nucleotide
  modified_base (11)..(11): 2'-OMe-nucleotide
  modified_base (13)..(13): 2'-OMe-nucleotide
  modified_base (15)..(15): 2'-OMe-nucleotide
  modified_base (17)..(17): 2'-OMe-nucleotide
  modified_base (19)..(19): 2'-OMe-nucleotide
  modified_base (20)..(20): 2'-OMe-nucleotide
  modified_base (21)..(21): 2'-OMe-nucleotide
ugccuucacauagucauccuu

SEQ ID NO: 1451 - RNA, 21 nt, Artificial Sequence
  Description of Artificial Sequence: Synthetic oligonucleotide
  modified_base (11)..(11): 2'-OMe-nucleotide
  modified_base (13)..(13): 2'-OMe-nucleotide
  modified_base (15)..(15): 2'-OMe-nucleotide
  modified_base (17)..(17): 2'-OMe-nucleotide
  modified_base (19)..(19): 2'-OMe-nucleotide
  modified_base (20)..(20): 2'-OMe-nucleotide
  modified_base (21)..(21): 2'-OMe-nucleotide
ugccuucacauagucauccuu

SEQ ID NO: 1452 - RNA, 21 nt, Artificial Sequence
  Description of Artificial Sequence: Synthetic oligonucleotide
  modified_base (20)..(20): a, c, u, g, unknown or other
  modified_base (21)..(21): a, c, u, g, unknown or other
gaagccuuuugagacccugnn

SEQ ID NO: 1453 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuguu

SEQ ID NO: 1454 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuguu

SEQ ID NO: 1455 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuguu

SEQ ID NO: 1456 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuguu

SEQ ID NO: 1457 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuguu

SEQ ID NO: 1458 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuguu

SEQ ID NO: 1459 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuguu

SEQ ID NO: 1460 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuguu

SEQ ID NO: 1461 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuguu

SEQ ID NO: 1462 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
gaagccuuuugagacccuguu

SEQ ID NO: 1463 - RNA, 21 nt, Artificial Sequence
  Description of Artificial Sequence: Synthetic oligonucleotide
  modified_base (1)..(1): 2'-OMe-nucleotide
  modified_base (3)..(3): 2'-OMe-nucleotide
  modified_base (5)..(5): 2'-OMe-nucleotide
  modified_base (7)..(7): 2'-OMe-nucleotide
  modified_base (9)..(9): 2'-OMe-nucleotide
  modified_base (20)..(20): 2'-OMe-nucleotide
  modified_base (21)..(21): 2'-OMe-nucleotide
gaagccuuuugagacccuguu

SEQ ID NO: 1464 - RNA, 21 nt, Artificial Sequence
  Description of Artificial Sequence: Synthetic oligonucleotide
  modified_base (20)..(20): a, c, u, g, unknown or other
  modified_base (21)..(21): a, c, u, g, unknown or other
cagggucucaaaaggcuucnn

SEQ ID NO: 1465 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
cagggucucaaaaggcuucuu

SEQ ID NO: 1466 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
cagggucucaaaaggcuucuu

SEQ ID NO: 1467 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
cagggucucaaaaggcuucuu

SEQ ID NO: 1468 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
cagggucucaaaaggcuucuu

SEQ ID NO: 1469 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
cagggucucaaaaggcuucuu

SEQ ID NO: 1470 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
cagggucucaaaaggcuucuu

SEQ ID NO: 1471 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
cagggucucaaaaggcuucuu

SEQ ID NO: 1472 - DNA, 21 bp, Artificial Sequence
  Description of Artificial Sequence: Synthetic oligonucleotide
  Description of Combined DNA/RNA Molecule: Synthetic oligonucleotide
cagggucucaaaaggcuucuu

SEQ ID NO: 1473 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
cagggucucaaaaggcuucuu

SEQ ID NO: 1474 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
cagggucucaaaaggcuucuu

SEQ ID NO: 1475 - DNA, 21 bp, Artificial Sequence
  Description of Artificial Sequence: Synthetic oligonucleotide
  Description of Combined DNA/RNA Molecule: Synthetic oligonucleotide
  modified_base (14)..(14): 2'-OMe-nucleotide
  modified_base (16)..(16): 2'-OMe-nucleotide
  modified_base (18)..(18): 2'-OMe-nucleotide
  modified_base (20)..(20): 2'-OMe-nucleotide
  modified_base (21)..(21): 2'-OMe-nucleotide
cagggucucaaaaggcuucuu

SEQ ID NO: 1476 - RNA, 21 nt, Artificial Sequence
  Description of Artificial Sequence: Synthetic oligonucleotide
  modified_base (20)..(20): a, c, u, g, unknown or other
  modified_base (21)..(21): a, c, u, g, unknown or other
ccucaucuacaccaacuaunn

SEQ ID NO: 1477 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccucaucuacaccaacuauuu

SEQ ID NO: 1478 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccucaucuacaccaacuauuu

SEQ ID NO: 1479 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccucaucuacaccaacuauuu

SEQ ID NO: 1480 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccucaucuacaccaacuauuu

SEQ ID NO: 1481 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccucaucuacaccaacuauuu

SEQ ID NO: 1482 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccucaucuacaccaacuauuu

SEQ ID NO: 1483 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccucaucuacaccaacuauuu

SEQ ID NO: 1484 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccucaucuacaccaacuauuu

SEQ ID NO: 1485 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccucaucuacaccaacuauuu

SEQ ID NO: 1486 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
ccucaucuacaccaacuauuu

SEQ ID NO: 1487 - RNA, 21 nt, Artificial Sequence
  Description of Artificial Sequence: Synthetic oligonucleotide
  modified_base (1)..(1): 2'-OMe-nucleotide
  modified_base (3)..(3): 2'-OMe-nucleotide
  modified_base (5)..(5): 2'-OMe-nucleotide
  modified_base (7)..(7): 2'-OMe-nucleotide
  modified_base (9)..(9): 2'-OMe-nucleotide
  modified_base (20)..(20): 2'-OMe-nucleotide
  modified_base (21)..(21): 2'-OMe-nucleotide
ccucaucuacaccaacuauuu

SEQ ID NO: 1488 - RNA, 21 nt, Artificial Sequence
  Description of Artificial Sequence: Synthetic oligonucleotide
  modified_base (20)..(20): a, c, u, g, unknown or other
  modified_base (21)..(21): a, c, u, g, unknown or other
auaguugguguagaugaggnn

SEQ ID NO: 1489 - RNA, 21 nt, Artificial Sequence
  Description of Artificial Sequence: Synthetic oligonucleotide
  modified_base (20)..(20): 2'-OMe-nucleotide
  modified_base (21)..(21): 2'-OMe-nucleotide
auaguugguguagaugagguu

SEQ ID NO: 1490 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
auaguugguguagaugagguu

SEQ ID NO: 1491 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
auaguugguguagaugagguu

SEQ ID NO: 1492 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
auaguugguguagaugagguu

SEQ ID NO: 1493 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
auaguugguguagaugagguu

SEQ ID NO: 1494 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
auaguugguguagaugagguu

SEQ ID NO: 1495 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
auaguugguguagaugagguu

SEQ ID NO: 1496 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
auaguugguguagaugagguu

SEQ ID NO: 1497 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
auaguugguguagaugagguu

SEQ ID NO: 1498 - DNA, 21 bp, Artificial Sequence
  Description of Artificial Sequence: Synthetic oligonucleotide
  Description of Combined DNA/RNA Molecule: Synthetic oligonucleotide
  modified_base (20)..(20): 2'-OMe-nucleotide
  modified_base (21)..(21): 2'-OMe-nucleotide
auaguugguguagaugagguu

SEQ ID NO: 1499 - DNA, 21 bp, Artificial Sequence
  Description of Artificial Sequence: Synthetic oligonucleotide
  Description of Combined DNA/RNA Molecule: Synthetic oligonucleotide
  modified_base (14)..(14): 2'-OMe-nucleotide
  modified_base (16)..(16): 2'-OMe-nucleotide
  modified_base (18)..(18): 2'-OMe-nucleotide
  modified_base (20)..(20): 2'-OMe-nucleotide
  modified_base (21)..(21): 2'-OMe-nucleotide
auaguugguguagaugagguu

SEQ ID NO: 1500 - DNA, 50 bp, Artificial Sequence
  Description of Artificial Sequence: Synthetic oligonucleotide
  Description of Combined DNA/RNA Molecule: Synthetic oligonucleotide
ctcgaggggcaactgaagccttttgagaccctgctgtcccaggcggccgc

SEQ ID NO: 1501 - DNA, 50 bp, Artificial Sequence
  Description of Artificial Sequence: Synthetic oligonucleotide
  Description of Combined DNA/RNA Molecule: Synthetic oligonucleotide
ctcgagctgggacagcagggtctcaaaaggcttcagttgcccgcggccgc

SEQ ID NO: 1502 - DNA, 50 bp, Artificial Sequence
  Description of Artificial Sequence: Synthetic oligonucleotide
  Description of Combined DNA/RNA Molecule: Synthetic oligonucleotide
ctcgaggggcaactctacgcaaaacagaccctgctgtcccaggcggccgc

SEQ ID NO: 1503 - DNA, 71 bp, Artificial Sequence
  Description of Artificial Sequence: Synthetic oligonucleotide
  Description of Combined DNA/RNA Molecule: Synthetic oligonucleotide
ctcgaggggcaactctacgcaaaacagaccctgctctacgcaaaacagaccctgctgtcccaggcggccgc

SEQ ID NO: 1504 - DNA, 92 bp, Artificial Sequence
  Description of Artificial Sequence: Synthetic oligonucleotide
  Description of Combined DNA/RNA Molecule: Synthetic oligonucleotide
ctcgaggggcaactctacgcaaaacagaccctgctctacgcaaaacagaccctgctctacgcaaaacagaccctgctgtcccaggcggccgc

SEQ ID NO: 1505 - DNA, 113 bp, Artificial Sequence
  Description of Artificial Sequence: Synthetic oligonucleotide
  Description of Combined DNA/RNA Molecule: Synthetic oligonucleotide
ctcgaggggcaactctacgcaaaacagaccctgctctacgcaaaacagaccctgctctacgcaaaacagaccctgctctacgcaaaacagaccctgctgtcccaggcggccgc

What is claimed is:

1. A nucleic acid molecule for inhibiting expression of GST-π comprising a sense strand and an antisense strand, wherein the strands form a duplex region, wherein the antisense strand is CAGGGUCUCAAAAGGCUUCNN (SEQ ID NO: 1464) and the sense strand is GAAGCCUUUUGAGACCCUGNN (SEQ ID NO: 1452), and wherein N is selected from the group of A, C, G, U, 2'-OMe-U, a, c, g, u, t, an inverted nucleotide, and a chemically modified nucleotide.

2. The nucleic acid molecule of claim 1, wherein one or more of the nucleotides in the duplex region is chemically-modified.

3. The nucleic acid molecule of claim 2, wherein the chemically-modified nucleotides are selected from 2'-deoxy nucleotides, 2'-O-alkyl substituted nucleotides, 2'-deoxy-2'-fluoro substituted nucleotides, phosphorothioate nucleotides, locked nucleotides, and any combination thereof.

4. The nucleic acid molecule of claim 2, wherein the antisense strand has deoxynucleotides in a plurality of positions, which plurality of positions are one of the following:
   each of positions 4, 6 and 8, from the 5' end of the antisense strand;
   each of positions 3, 5 and 7, from the 5' end of the antisense strand;
   each of positions 1, 3, 5 and 7, from the 5' end of the antisense strand;
   each of positions 3-8, from the 5' end of the antisense strand; or
   each of positions 5-8, from the 5' end of the antisense strand.

5. The nucleic acid molecule of claim 4, wherein the molecule has one or more 2'-deoxy-2'-fluoro substituted nucleotides in the duplex region.

6. The nucleic acid molecule of claim 1, wherein the antisense strand is cagggucuCAAAAGGCUUC<u>UU</u> (SEQ ID NO: 1466) and the sense strand is GAAGCCUUUUGAGACCCUG<u>UU</u> (SEQ ID NO: 1454), wherein the underlined nucleotides are 2'-OMe-U, and wherein lower case a, u, g, and c refer to 2'-deoxy-A, 2'-deoxy-U, 2'-deoxy-G, and 2'-deoxy-C, respectively.

7. The nucleic acid molecule of claim 1, wherein the antisense strand is CagggucuCAAAAGGCUUC<u>UU</u> (SEQ ID NO: 1467) and the sense strand is GAAGCC<u>UU</u>UUGAGACCCUG<u>UU</u> (SEQ ID NO: 1455), wherein the underlined nucleotides are 2'-OMe-U, and wherein lower case a, u, g, and c refer to 2'-deoxy-A, 2'-deoxy-U, 2'-deoxy-G, and 2'-deoxy-C, respectively.

8. The nucleic acid molecule of claim 1, wherein the antisense strand is CagggucuCAAAAGGCUUC<u>UU</u> (SEQ ID NO: 1468) and the sense strand is GAAGCC<u>UU</u>UUGAGACCCUG<u>UU</u> (SEQ ID NO: 1456), wherein the underlined nucleotides are 2'-OMe-U, and wherein lower case a, u, g, and c refer to 2'-deoxy-A, 2'-deoxy-U, 2'-deoxy-G, and 2'-deoxy-C, respectively.

9. The nucleic acid molecule of claim 1, wherein the antisense strand is CAGggucuCAAAAGGCUUC<u>UU</u> (SEQ ID NO: 1469) and the sense strand is AAGCCUUUUGAGACCCUG<u>UU</u> (SEQ ID NO: 1457), wherein the underlined nucleotides are 2'-OMe-U, and wherein lower case a, u, g, and c refer to 2'-deoxy-A, 2'-deoxy-U, 2'-deoxy-G, and 2'-deoxy-C, respectively.

10. The nucleic acid molecule of claim 1, wherein the antisense strand is CAGggucuCAAAAGGCUUC<u>UU</u> (SEQ ID NO: 1470) and the sense strand is GAAGCC<u>UU</u>UUGAGACCCUG<u>UU</u> (SEQ ID NO: 1458), wherein the underlined nucleotides are 2'-OMe-U, and wherein lower case a, u, g, and c refer to 2'-deoxy-A, 2'-deoxy-U, 2'-deoxy-G, and 2'-deoxy-C, respectively.

11. The nucleic acid molecule of claim 1, wherein the antisense strand is cAgGgUcUCAAAAGGCUUC<u>UU</u> (SEQ ID NO: 1471) and the sense strand is GAAGCC<u>UU</u>UUGAGACCCUG<u>UU</u> (SEQ ID NO: 1459), wherein the underlined nucleotides are 2'-OMe-U, and wherein lower case a, u, g, and c refer to 2'-deoxy-A, 2'-deoxy-U, 2'-deoxy-G, and 2'-deoxy-C, respectively.

12. The nucleic acid molecule of claim 1, wherein the antisense strand is CAgGgUcUCAAAAGGCUUC<u>UU</u> (SEQ ID NO: 1472) and the sense strand is GAAGCCUUUUGAGACCCUG<u>UU</u> (SEQ ID NO: 1460), wherein the underlined nucleotides are 2'-OMe-U, and wherein lower case a, u, g, and c refer to 2'-deoxy-A, 2'-deoxy-U, 2'-deoxy-G, and 2'-deoxy-C, respectively.

13. The nucleic acid molecule of claim 1, wherein the molecule inhibits expression of GST-π mRNA in A549 cells with an IC50 of less than 200 pM.

14. The nucleic acid molecule of claim 1, wherein the molecule inhibits expression of GST-π mRNA in A549 cells with an IC50 of less than 50 pM.

15. A vector or cell comprising the nucleic acid molecule of claim 1.

16. A pharmaceutical composition comprising the nucleic acid molecule of claim 1 and a pharmaceutically acceptable carrier.

17. The pharmaceutical composition of claim 16, wherein the carrier is a formulation of one or more lipid molecules.

18. The pharmaceutical composition of claim 16, wherein the carrier is a formulation containing liposomes.

19. The pharmaceutical composition of claim 18, wherein the liposomes encapsulate the nucleic acid molecule.

20. A method for treating pancreatic cancer, the method comprising administering to a subject in need a composition of claim 16.

21. A method for treating lung cancer, the method comprising administering to a subject in need a composition of claim 16.

* * * * *